US011932886B2

(12) United States Patent
Chen et al.

(10) Patent No.: US 11,932,886 B2
(45) Date of Patent: Mar. 19, 2024

(54) ENGINEERED TRANSAMINASE POLYPEPTIDES AND USES THEREOF

(71) Applicant: Enzymaster (Ningbo) Bio-Engineering Co., Ltd, Ningbo (CN)

(72) Inventors: Haibin Chen, Ningbo (CN); Yong Koy Bong, Ningbo (CN); Juanjuan Wang, Ningbo (CN); Baoqin Cai, Ningbo (CN); Chuanyang Shang, Ningbo (CN); Marco Bocola, Ningbo (CN)

(73) Assignee: ENZYMASTER (NINGBO) BIO-ENGINEERING CO., LTD., Ningbo (CN)

( * ) Notice: Subject to any disclaimer, the term of this patent is extended or adjusted under 35 U.S.C. 154(b) by 921 days.

(21) Appl. No.: 16/761,785

(22) PCT Filed: Dec. 22, 2018

(86) PCT No.: PCT/CN2018/122962
§ 371 (c)(1),
(2) Date: May 5, 2020

(87) PCT Pub. No.: WO2019/128894
PCT Pub. Date: Jul. 4, 2019

(65) Prior Publication Data
US 2020/0332321 A1    Oct. 22, 2020

(30) Foreign Application Priority Data

Dec. 26, 2017  (CN) .......................... 201711430922.6

(51) Int. Cl.
C12P 13/00     (2006.01)
C12N 9/10      (2006.01)
C12N 11/00     (2006.01)
C12N 15/70     (2006.01)

(52) U.S. Cl.
CPC .......... *C12P 13/001* (2013.01); *C12N 9/1096* (2013.01); *C12N 11/00* (2013.01); *C12N 15/70* (2013.01)

(58) Field of Classification Search
CPC ..... C12P 13/001; C12N 9/1096; C12N 11/00; C12N 15/70
See application file for complete search history.

(56) References Cited

FOREIGN PATENT DOCUMENTS

| CN | 104630170 A | 5/2015 |
| CN | 107653233 A | 2/2018 |
| WO | WO 2011/026556 A1 | 3/2011 |

OTHER PUBLICATIONS

Singh RK et al. Protein Engineering Approaches in the Post-Genomic Era. 2017. Current Protein and Peptide Science. 18. 1-11. ( Year: 2017).*
Zhang M et al. Propagated Perturbations from a Peripheral Mutation Show Interactions Supporting WW Domain Thermostability. 2018. Structure. 26, 1474-1485. (Year: 2018).*
NCBI Reference Sequence: XP_748821.1, "branched-chain amino acid aminotransferase, putative [Aspergillus fumigatus Af293]" (Apr. 3, 2018).
PDB: 4CHI_A, "Chain A, Branched-chain Amino Acid Aminotransferase", (Oct. 26, 2017).
NCBI Reference Sequence: XP_001261640.1, "aminotransferase, class IV, putative [Aspergillus fischeri NRRL 181]" (Jul. 12, 2017).
GenBank: GAO81049.1, "putative branched-chain-amino-acid aminotransferase [Aspergillus udagawae]" (Oct. 6, 2015).
GenBank: GAQ05945.1, "putative branched-chain-amino-acid aminotransferase [Aspergillus lentulus]" (Nov. 13, 2015).
Thomsen, M. et al., "Crystallization and preliminary X-ray diffraction studies of the (R)-selective amine transaminase from *Aspergillus fumigatus*", Acta Cryst., vol. 69(Pt 12): pp. 1415-1417, Dec. 31, 2013.

* cited by examiner

*Primary Examiner* — Paul J Holland
(74) *Attorney, Agent, or Firm* — Smith Patent, LLC; Chalin A. Smith

(57) ABSTRACT

Provided are amino acid sequences of engineered transaminase polynucleotide that are useful for asymmetrically synthesizing chiral amine compounds, and its preparation process and reaction process under industrial-relevant conditions. Also provided are polynucleotide sequences encoding engineered transaminase polypeptides, engineered host cells capable of expressing engineered transaminase polypeptides, and methods of producing chiral amine compounds using engineered transaminase polypeptides. Compared to other enzymes, the engineered transaminase polypeptides provided by this invention have better catalytic activity and stability, and are not inhibited by chiral amine products in the synthesis process. The use of the engineered polypeptides of the present invention for the preparation of chiral amine compound results in higher unit activity, and has good industrial application prospects.

14 Claims, No Drawings
Specification includes a Sequence Listing.

ENGINEERED TRANSAMINASE POLYPEPTIDES AND USES THEREOF

PRIORITY

This application corresponds to the U.S. National phase of International Application No. PCT/CN2018/122962, filed Dec. 22, 2018, which, in turn, claims priority to Chinese Patent Application No. 2017-11430922.6 filed Dec. 26, 2017, the contents of which are incorporated by reference herein in their entirety.

SEQUENCE LISTING

The instant application contains a Sequence Listing that has been submitted in ASCII format via EFS-Web and is hereby incorporated by reference in its entirety. Said ASCII copy, created on May 5, 2020, is named LNK_213 US_SEQ_LIST_TXT.txt and is 862,080 bytes in size.

TECHNICAL FIELD OF THE PRESENT INVENTION

The present invention relates to the field of biotechnology, in particular to engineered transaminase polypeptides and their applications.

BACKGROUND OF THE PRESENT INVENTION

Chiral amines are a kind of important compounds that are used widely in fine chemical, pharmaceutical, health, agricultural and materials industries. Especially in the pharmaceutical industry, chiral amines are often used as intermediates in the preparation of various drugs, such as cephalosporins, neurological drugs, cardiovascular drugs, antihypertensive drugs, anti-infective drugs and vaccines. Sitagliptin is the main component of the anti-diabetic oral drug Januvia, and it is an amine with a R-enantiomeric stereocenter. Conventional method to prepare chiral amine compounds generally involves reactions under extreme conditions (high temperature, high pressure, etc.). And in order to obtain products with high chiral purity, cumbersome resolution or recrystallization steps are required, which generates a large amount of waste, resulting in high cost and pollutions. This urges people to find a more efficient way to prepare chiral amines, and the emergence of transaminase has enabled researchers to see the dawn. Transaminase has been favored by the industry for its high selectivity, high conversion rate and mild reaction conditions. Transaminase is capable of catalyzing the transfer of an amino group from an amine donor to a ketone substrate to give a chiral amine product and a ketone by-product (Scheme 1). The reaction requires pyridoxal phosphate (PLP) as cofactor.

Although transaminases have a very good application prospective in the synthesis of chiral amine compounds, the wild-type transaminases found in nature are often not active enough, or have insufficient stability or insufficient stereoselectivity, or can not accept the desired substrate, or have substrate and/or product inhibition. Therefore, it is often not possible to directly apply wild-type transaminases in industrial production (Fei Guo and Per Berglund, Transaminase biocatalysis: optimization and application, Green Chemistry, 2017, 19, 333-360). In recent years, with the rise of protein engineering technology, the performance of transaminase can be improved by directed evolution technology to meet the process requirements for the synthesis of specific chiral amine compounds. This invention, using a wild-type transaminase as a starting point and R-(+)-α-phenylethylamine (referred to as R-PEA) as model product, has developed a series of engineered transaminase polypeptides with high activity, high stability, high stereoselectivity, and/or a broader range of substrates.

R-PEA is an important chemical intermediate, and its derivatives have a wide range of applications in the pharmaceutical, chemical, emulsifier and dye industries. It can be used to resolve certain racemic acids, alcohols, esters, etc., and can also be used as auxiliaries or raw materials for the synthesis of certain chiral substances. Therefore, it is very important to study and improve the synthesis of R-PEA. The preparation of R-PEA includes extraction from natural sources, racemic resolution and the like. The direct extraction of biologically active chiral compounds from natural products is the most direct method, but the natural raw materials are limited and costly. The most commonly used method is to isolate R-PEA from racemic α-phenylethylamine by resolution, which gives a theoretical yield of up to 50%. Compared to the chemical synthesis method, the biocatalytic synthesis method using transaminase not only enables higher yield and optical purity without resolution but also has mild reaction conditions, lower cost and less environmental pollution.

SUMMARY OF THE PRESENT INVENTION

Brief Description of the Schemes

Scheme 1 depicts the catalytic reaction of a transaminase.

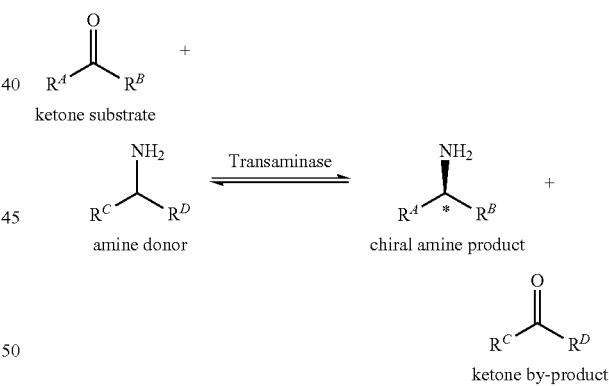

Scheme 2 depicts transaminase-catalyzed reaction of acetophenone to R-(+)-α-phenylethylamine (R-PEA).

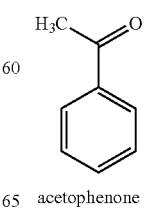

acetophenone

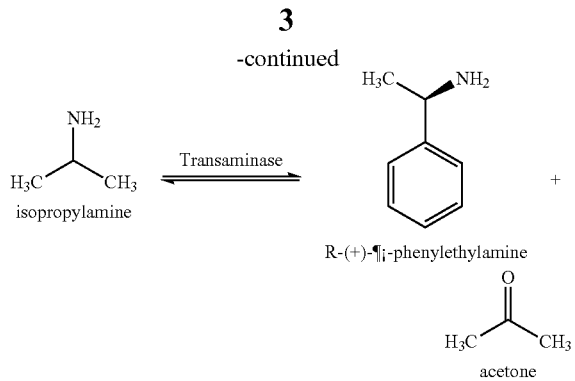

Overview

This invention provides engineered transaminase polypeptides with high stereoselectivity, high catalytic activity and good stability, which can asymmetrically synthesize chiral amine compounds by transamination from an achiral ketone, and in particular asymmetrically synthesize R-(+)-α-phenylethylamine (Scheme 2). The present invention also provides gene sequences of engineered transaminase polypeptides, recombinant expression vectors containing the gene, engineered strains and efficient methods for the production thereof, as well as reaction processes for asymmetrically synthesis of chiral amine compounds using engineered polypeptides.

In the first aspect, the present invention provides engineered transaminase polypeptides. These engineered polypeptides are derived from a wild-type transaminase through a creative process of directed evolution, comprising a certain number of amino-acid-residue substitutions, insertions or deletions. The wild-type transaminase is from *Aspergillus fumigatus*, and its amino acid sequence is shown as SEQ ID No: 2. This wild-type transaminase showed low activity and poor stability, and phenylethylamine inhibits this enzyme. As measured by the inventors, in the reaction (Scheme 2) using transaminase of SEQ ID No: 2, with the acetophenone loading of 2 g/L, and the transaminase loading of 10 g/L (0.5 M isopropylamine, 0.1 mM PLP, 10% (v/v) methanol, pH 9.0, 30° C.), the R-PEA conversion was 1.5%, and no more R-PEA was formed after 6 hours of reaction. R-PEA has a very strong inhibitory effect on the wild-type transaminase of SEQ ID No: 2. When R-PEA concentration is 0.5 g/L in the reaction, the transaminase of SEQ ID No: 2 is inhibited in converting acetophenone to R-PEA.

The engineered transaminase polypeptide provided in the present invention has higher activity and/or stability than the wild-type transaminase corresponding to SEQ ID NO: 2, and is capable of asymmetrically synthesizing chiral amine compounds with extremely high stereoselectivity, in particular catalyzing the conversion of acetophenone to R-PEA (Scheme 2) with high efficiency; or, in the presence of high concentrations of R-PEA, the engineered transaminase polypeptides provided in the present invention are still capable of catalyzing the conversion of acetophenone to R-PEA with low inhibition. These engineered transaminase polypeptides can comprise an amino acid sequence that differs from the sequence of SEQ ID NO: 2 in one or more residue positions selected from: X3, X4, X9, X18, X19, X31, X36, X40, X41, X47, X50, X53, X54, X56, X59, X60, X61, X62, X72, X78, X86, X98, X101, X113, X114, X115, X116, X122, X123, X124, X125, X126, X127, X128, X129, X130, X141, X143, X148, X153, X155, X156, X159, X162, X167, X173, X174, X175, X181, X182, X186, X187, X188, X190, X191, X194, X199, X209, X214, X219, X226, X235, X240, X243, X244, X252, X253, X262, X266, X271, X272, X273, X275, X278, X281, X287, X291, X302, X307, X312, X323. In some embodiments, the engineered transaminase polypeptides comprise an amino acid sequence comprising at least one of the following features (these features are substitutions of amino acid residues to the reference sequence of SEQ ID NO: 2): 53T, M4I, S9A, L18H, L18I, E19T, E19A, Y31W, L36F, S40Y, S40T, D41E, L47P, G50A, H53T, H53P, H53A, H53R, H53G, H53N, H53S, H53F, H53L, S54A, L56A, L56V, L56S, D59S, D59T, V60T, I61F, S62R, S62H, S62N, S62A, D72G, I78L, R86C, N98K, A101V, A101H, F113M, F113W, V114G, E115K, E115H, E115Y, E115F, V116I, L122T, T123S, T123I, G124S, V125D, V125N, R126Q, R126N, R126D, R126W, R126G, R126H, G127F, G127K, G127S, G127P, S128R, S128N, K129N, K129Q, P130Q, P130E, P130A, L141Q, L141T, L143S, L143R, V148L, N153D, N153K, L155S, L155I, L155R, H156L, H156I, H156R, E159S, I162V, R167V, A173D, F174S, F174I, D175Y, D175G, L181Y, L181F, Q182M, L186F, T187I, T187N, T187R, K188R, L190M, F191V, M194K, M194L, M194R, M194E, M194N, M194V, M194D, M194I, M194G, T199K, T199Q, T199E, N209H, S214C, S214P, V219I, V219L, I226L, R235E, K240D, K240S, K240Q, I243F, D244E, D252P, I253V, O262T, Q262A, O262F, S266A, M271C, C272T, T273S, A275G, I278V, I281V, Q287K, D291G, W302M, E307N, P312A, P312N, G323D; Or, in addition to the abovementioned differences, engineered transaminase polypeptides comprise insertions or deletions of 1, 2, 3, 4, 5, 6, 7, 8, 9, 10, 11, 12, 13, 14, 15, 16, 18, 20, 21, 22, 23, 24, 25 or more amino acid residues.

More specifically, in some embodiments, the engineered transaminase polypeptides which were improved over SEQ ID NO: 2 comprise a sequence corresponding to SEQ ID No: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400.

In some embodiments, the engineered transaminase polypeptides comprise an amino acid sequence that is at least 80%, 85%, 86%, 87%, 88%, 89%, 90%, 90%, 91%, 92%, 93%, 94%, 95%, 96%, 97%, 98%, 99% or more identical to the reference sequence of SEQ ID No: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400.

The identity between two amino acid sequences or two nucleotide sequences can be obtained by commonly used algorithms in the art and can be calculated according to default parameters by using NCBI Blastp and Blastn software, or by using the Clustal W algorithm (Nucleic Acid Research, 22 (22): 4673-4680, 1994). For example, using the Clustal W algorithm, the amino acid sequence identity of SEQ ID NO: 2 to SEQ ID NO: 72 is 88.2%.

In another aspect, this invention provides polynucleotide sequences encoding engineered transaminase polypeptides. In some embodiments, a polynucleotide can be part of an expression vector having one or more control sequences for the expression of an engineered transaminase polypeptide. In some embodiments, polynucleotides can comprise sequences corresponding to SEQ ID No: 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399.

As known to people skilled in the art, due to the degeneracy of the nucleotide codons, the polynucleotide sequences encoding amino acid sequences SEQ ID No: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400 are not limited to SEQ ID No: 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399. The polynucleotide sequences of the engineered transaminase polypeptides of the present invention may also be any other polynucleotide sequences encoding amino acid sequences SEQ ID No: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400.

In another aspect, this disclosure provides polynucleotides comprising sequences encoding engineered transaminase polypeptides, expression vectors and host cells capable of expressing engineered transaminase polypeptides. In some embodiments, the host cell can be bacterial host cell, such as E. coli. The host cell can be used to express and isolate the engineered transaminase described herein, or alternatively be directly used in the reaction for conversion of substrates to products.

In some embodiments, the engineered transaminase polypeptides in the form of whole cell, crude extract, isolated enzyme, or purified enzyme can be used alone or in an immobilized form, such as immobilization on a resin.

The present disclosure also provides the process of converting a ketone substrate of formula (II) to a chiral amine compound of formula (I) using the engineered transaminase polypeptides disclosed herein:

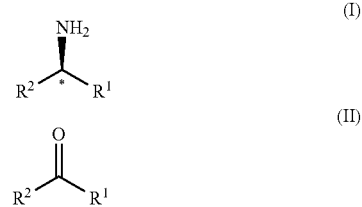

where the amine products of formula (I) have the indicated stereochemical configuration shown at the chiral center marked with an*; the amine products of formula (I) are in enantiomeric excess over the other isomer, wherein $R^1$ is optionally substituted or unsubstituted aryl or heteroaryl, or optionally substituted or unsubstituted $C_1$-$C_8$ hydrocarbyl, or

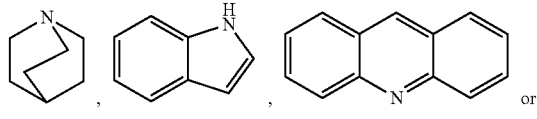

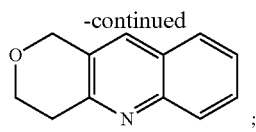
;

$R^2$ is optionally substituted or unsubstituted $C_1$-$C_6$ hydrocarbyl, halogen (such as —F, —Cl, —Br, and —I), —$NO_2$, —NO, —$SO_2R'$ or —SOR', —SR', —NR'R', —OR', —$CO_2R'$ or —COR', —C(O)NR', —$SO_2NH_2$ or —$SONH_2$, —CN, $CF_3$;

wherein each R' is independently selected from —H or ($C_1$-$C_4$) hydrocarbyl, the process comprising that, under suitable reaction conditions of converting the ketone substrate to an amine product, the ketone substrate of formula (II) and the amine donor were contacted with transaminase polypeptides, wherein the transaminase polypeptides are engineered transaminase polypeptides as described herein. In some embodiments, the engineered transaminase polypeptides have at least 80%, 85%, 86%, 87%, 88%, 89%, 90%, 91%, 92%, 93%, 94%, 95%, 96%, 97%, 98%, 99% or more of sequence identity to SEQ ID NO: 2 and are capable of converting ketone substrate of structural formula (II) to the amine product of formula (I) at higher conversion compared to SEQ ID NO:2.

In some embodiments, the amine products of formula (I) are present in an enantiomeric excess of at least 60%, 65%, 70%, 75%, 80%, 85%, 90%, 91%, 92%, 93%, 94%, 95%, 96%, 97%, 98%, 99% or greater.

In some embodiments of this process, the amine products of formula (I) are:

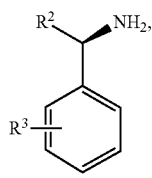

wherein $R^3$ is $C_1$-$C_4$ hydrocarbyl, —H, halogen such as —F, —Cl, —Br and —I, —$NO_2$, —NO, —$SO_2R'$ or —SOR', —SR', —NRR', —OR', —$CO_2R'$ or —COR', —C(O)NR', —$SO_2NH_2$ or —$SONH_2$, —CN, $CF_3$, wherein each R' is independently selected from —H or ($C_1$-$C_4$) hydrocarbyl; $R^3$ may also be

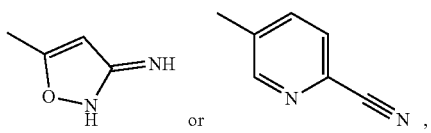

$R^2$ is as defined above, and the ketone substrate of formula (II) is:

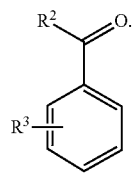

In some embodiments, $R^3$ is in the para position of the phenyl ring. In some embodiments, $R^3$ is in the meta position of the phenyl ring. In some embodiments, $R^3$ is ortho to the phenyl ring. In some embodiments, $R^3$ is both para and meta to the phenyl ring. In some embodiments, $R^3$ is both para and ortho to the phenyl ring. In some embodiments, $R^3$ is both meta and ortho to the phenyl ring.

In some embodiments of the process, the amine product of formula (I) is:

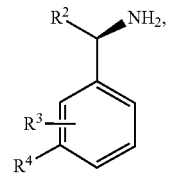

wherein $R^4$ is defined the same as $R^3$ above, $R^3$ and $R^2$ are as defined above, and the ketone substrate of formula (II) is:

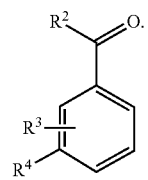

In some embodiments, $R^3$ is in the meta position of the phenyl ring. In some embodiments, $R^3$ is ortho to the phenyl ring.

In some embodiments, the engineered transaminase polypeptides can be used in the production process of enantiomeric excess of the compound of formula A2, R-PEA:

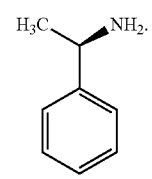

In these embodiments, the production process comprises that, under suitable reaction conditions for converting compound of formula A1 to compound of formula A2, in a suitable organic solvent, in the presence of amine donor, the compound of formula A1:

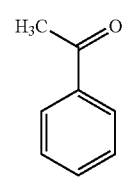

were contacted with the engineered transaminase polypeptides disclosed herein.

In some embodiments of the above processes, the compound of formula (I) or the compound of formula A2 is present in an enantiomeric excess of at least 60%, 65%, 70%, 75%, 80%, 85%, 90%, 91%, 92%, 93% 94%, 95%, 96%, 97%, 98% or 99% or more.

Specific embodiments of engineered transaminase polypeptides for use in this method are further provided in the detailed description. An engineered transaminase polypeptide that can be used in the above process can comprise one or more sequences selected from the amino acid sequences corresponding to SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400.

Any of the processes for the preparation of a compound of formula (I) or a compound of formula A2 using an engineered polypeptide as disclosed herein can be performed under a range of suitable reaction conditions, which including, but not limited to, amine donor, pH, temperature, buffer, solvent system, substrate loading, polypeptide loading, cofactor loading, pressure and reaction time range. For example, in some embodiments, preparing a compound of formula (I) or a compound of formula A2 may be performed, wherein suitable reaction conditions include: (a) about 1 g/L to 200 g/L of a substrate compound (e.g. compound of formula (II) or A1); (b) about 0.1 g/L to 50 g/L of engineered polypeptide; (c) about 10 g/L to 300 g/L of amine donor loading; (d) about 0.1 mM-5 mM PLP cofactor; (e) from 0% (v/v) to about 60% (v/v) of organic solvent, including but not limited to, dimethylsulfoxide (DMSO), Dimethylformamide (DMF), methyl tert-butyl ether (MTBE), isopropyl acetate, methanol, ethanol or propanol; (F) a pH of about 7.0 to about 11.0; and (g) a temperature of about 10° C. to about 60° C.

DETAILED DESCRIPTION OF THE PRESENT INVENTION

1. Definitions

Unless explicitly defined otherwise, technical and scientific terms used in this disclosure have the meanings that are commonly understood by people skilled in the art.

"Protein", "polypeptide" and "peptide" are used interchangeably herein to denote a polymer of at least two amino acids covalently linked by an amide bond, regardless of length or post-translational modification (e.g., glycosylation, phosphorylation, lipidation, myristoylation, ubiquitination, etc.). This definition includes D-amino acids and L-amino acids, as well as mixtures of D-amino acids and L-amino acids.

"Engineered transaminase", "engineered transaminase polypeptide", "improved transaminase polypeptide" and "engineered polypeptide" are used interchangeably herein.

"Cells" or "wet cells" refers to host cells expressing a polypeptide or engineered polypeptide, including the wet cells obtained in the preparation procedures shown in Example 2 and Example 6.

"Polynucleotide" and "nucleic acid" are used interchangeably herein.

"Cofactor" as used herein refers to a non-protein compound that operates in conjunction with an enzyme in a catalytic reaction. As used herein, "cofactor" is intended to encompass the vitamin B6 family compounds pyridoxal-5'-phosphate (PLP), pyridoxine (pyridoxol, or PN), pyridoxal (PL), pyridoxamine (PM), pyridoxine phosphate (PNP) and pyridoxamine phosphate (PMP), which are sometimes also referred to as coenzymes.

"Pyridoxal phosphate", "PLP", "pyridoxal-5'-phosphate", "PYP" and "P5P" are used interchangeably herein to refer to compounds that act as coenzyme in transaminase reactions.

"Coding sequence" refers to that portion of a nucleic acid (e.g., a gene) that encodes an amino acid sequence of a protein.

"Naturally occurring" or "wild-type" refers to the form found in nature. For example, a naturally-occurring or wild-type polypeptide or polynucleotide sequence is a sequence that is present in an organism that can be isolated from sources in nature and which has not been intentionally modified by manual procedures.

"Recombinant" or "engineered" or "non-naturally occurring" when used with reference to, for example, a cell, nucleic acid or polypeptide, refers to a material or material corresponding to the native or native form of the material, that has been modified in a manner that would not otherwise exist in nature, or is identical thereto but produced or derived from synthetic material and/or by manipulation using recombinant techniques.

"Sequence identity" and "homology" are used interchangeably herein to refer to comparisons between polynucleotide sequences or polypeptide sequences ("sequence identity" is generally expressed as a percentage), and are determined by comparing two optimally aligned sequences over a comparison window, where the portion of the polynucleotide or polypeptide sequence in the comparison window may comprise additions or deletions (i.e., gaps) as compared to the reference sequence for optimal alignment of the two sequences. The percentage can be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those skilled in the art will appreciate that there are many established algorithms available to align two sequences. The optimal alignment of sequences for comparison can be conducted, for example, by the local homology algorithm of Smith and Waterman, 1981, Adv. Appl. Math. 2: 482, by the Homology alignment algorithm of Needleman and Wunsch, 1970, J. Mol. Biol. 48: 443, by the search for similarity method of Pearson and Lipman, 1988, Proc. Natl. Acad. Sci. USA 85: 2444, by computerized implementations of these algorithms (GAP, BESTFIT, FASTA, and TFASTA in the GCG Wisconsin Package) or by visual inspection (see generally, Current Protocols in Molecular Biology, F M Ausubel et al. eds., Current Protocols, a Joint Venture between Greene Publishing Associates, Inc. and John Wiley & Sons, Inc., (1995 Supplement) (Ausubel)). Examples of algorithms that are suitable for determining the percent sequence identity and percent sequence similarity are the BLAST and BLAST 2.0 algorithms, which are described in Altschul et al., 1990, J. Mol. Biol. 215: 403-410 and Altschul et al., 1977, Nucleic Acids Res. 3389-3402, respectively. Software for performing BLAST analysis is publicly available through the National Center for Biotechnology Information website. The algorithm involves first identifying high scoring sequence pairs (HSPs) by identifying short words of length W in the query sequence, which either match or satisfy some positive-valued threshold scores T when aligned with a word of the same length in the database sequence. T is referred to as, the neighborhood word score threshold (Altschul et al., Supra). These initial neighborhood word hits serve as seeds for initiating searches to find longer HSPs that contain them. The word hits are then extended in both directions along each sequence for as far as the cumulative alignment score can be increased. For nucleotide sequences, the cumulative scores are calculated using the parameters M (reward score for matched pair of residues; always >0) and N (penalty score for mismatched residues; always <0). For amino acid sequences, a scoring matrix is used to calculate the cumulative score. The extension of the word hits in each direction are halted when: the cumulative alignment score falls off by the quality X from its maximum achieved value; the cumulative score goes 0 or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, the expected value (E) of 10, M=5, N=−4, and a comparison of both strands as a default value. For amino acid sequences, the BLASTP program uses as defaults the wordlength (W) of 3, the expected value (E) of 10 and the BLOSUM62 scoring matrix (see Henikoff and Henikoff, 1989, Proc Natl Acad Sci USA 89: 10915). Exemplary determination of sequence alignments and % sequence identity can employ the BESTFIT or GAP programs in the GCG Wisconsin Software package (Accelrys, Madison WI), using the default parameters provided.

"Reference sequence" refers to a defined sequence that is used as a basis for sequence comparison. The reference sequence may be a subset of a larger sequence, for example, a full-length gene or a fragment of a polypeptide sequence. In general, a reference sequence is at least 20 nucleotides or amino acid residues in length, at least 25 residues long, at least 50 residues in length, or the full length of the nucleic acid or polypeptide. Because two polynucleotides or polypeptides may each (1) comprise a sequence (i.e., a portion of the complete sequence) that is similar between two sequences, and (2) may further comprise sequences that is divergent between the two sequences, sequence comparisons between two (or more) polynucleotides or polypeptides are typically performed by comparing the sequences of the two polynucleotides or polypeptides over a "comparison window" to identify and compare local regions of sequence similarity. In some embodiments, a "reference sequence" is not intended to be limited to a wild-type sequence, and may comprise engineered or altered sequences. For example, "a reference sequence with threonine at the residue corresponding to X40 based on SEQ ID NO: 2" refers to a reference sequence wherein the corresponding residue at position X40 in SEQ ID NO: 2 which is serine, has been altered to threonine.

A "comparison window" refers to a conceptual segment of at least about 20 contiguous nucleotide positions or amino acid residues, wherein the sequence may be compared to a reference sequence of at least 20 contiguous nucleotides or amino acids and wherein the portions of the sequence in the comparison window may comprise additions or deletions (i.e., gaps) of 20% or less as compared to a reference sequence (which does not comprise additions or deletions) for optimal alignment of the two sequences. The comparison window can be longer than 20 contiguous residues, and optionally include 30, 40, 50, 100 or more residues.

In the context of the numbering for a given amino acid or polynucleotide sequence, "corresponding to," "reference to" or "relative to" refers to the numbering of the residues of a specified reference when the given amino acid or polynucleotide sequence is compared to the reference sequence. In other words, the residue number or residue position of a given sequence is designated with respect to the reference sequence, rather than by the actual numerical position of the residue within the given amino acid or polynucleotide sequence. For example, a given amino acid sequence such as an engineered transaminase can be aligned to a reference sequence by introducing gaps to optimize residue matches between the two sequences. In these cases, although there are gaps, the numbering of the residue in a given amino acid or polynucleotide sequence is made with respect to the reference sequence to which they have been aligned.

"Amino acid difference" or "residue difference" refers to the difference in amino acid residues at a position of a polypeptide sequence relative to the amino acid residue at a corresponding position in the reference sequence. The positions of amino acid differences are generally referred to herein as "Xn", where n refers to the corresponding position in the reference sequence on which the residue differences are based. For example, "a residue difference at position X40 as compared to SEQ ID NO: 2" refers to the difference in amino acid residues at the polypeptide position corresponding to position 40 of SEQ ID NO: 2. Thus, if the reference polypeptide of SEQ ID NO: 2 has a serine at position 40, then "a residue difference at position X40 as compared to SEQ ID NO: 2" refers to an amino acid substitution of any residue other than serine at the position of the polypeptide corresponding to position 40 of SEQ ID NO: 2. In most of the examples herein, the specific amino acid residue difference at the position is indicated as "XnY", wherein "Xn" specified to the corresponding position as described above, and "Y" is the single letter identifier of the amino acid found in the engineered polypeptide (i.e., a different residue than in the reference polypeptide). In some examples (e.g., in Table 1), the present disclosure also provides specific amino acid differences denoted by the conventional notation "AnB", where A is a single letter identifier of a residue in the reference sequence, "n" is the number of residue position in the reference sequence, and B is the single letter identifier for the residue substitution in the sequence of the engineered polypeptide. In some examples, an engineered polypeptide of this disclosure may comprise one or more amino acid residue differences relative to a reference sequence, which is indicated by a list of specific positions at which residue differences are present relative to a reference sequence. In some embodiments, more than one amino acid residue can be used in a specific residue position of an engineered polypeptide, the various amino acid residues that can be used are separated by a "l" (e.g., X40T/X39Y).

"Deletion" refers to the modification of a polypeptide by removing one or more amino acids from a reference polypeptide. Deletions can include the removal of one or more amino acids, two or more amino acids, five or more amino acids, ten or more amino acids, fifteen or more amino acids, or twenty or more amino acids, up to 10% of the total number of amino acids of the enzyme, or up to 20% of the total number of amino acids making up the reference enzyme while retaining the enzymatic activity of the engineered transaminase and/or retaining the improved properties of the engineered transaminase. Deletion may involve the internal portion and/or the terminal portion of the polypeptide. In various embodiments, deletions may include a contiguous segment or may be discontinuous.

"Insertion" refers to the modification of a polypeptide by adding one or more amino acids from a reference polypeptide. In some embodiments, the improved engineered transaminase comprises insertions of one or more amino acids to a naturally-occurring transaminase polypeptide as well as insertions of one or more amino acids to other engineered transaminase polypeptides. It can be inserted in the internal portions of the polypeptide or inserted to the carboxyl or amino terminus. As used herein, insertions include fusion proteins known in the art. The insertion can be a contiguous segment of amino acids or separated by one or more amino acids in naturally-occurring or engineered polypeptides.

"Fragment" as used herein refers to a polypeptide having an amino terminal and/or carboxyl terminal deletion, but where the remaining amino acid sequence is identical to the corresponding position in the sequence. Fragments may be at least 10 amino acids long, at least 20 amino acids long, at least 50 amino acids long or longer, and up to 70%, 80%, 90%, 95%, 98% and 99% of the full-length transaminase polypeptide.

An "isolated polypeptide" refers to a polypeptide that is substantially separated from other substances with which it is naturally associated, such as proteins, lipids, and polynucleotides. The term comprises polypeptides that have been removed or purified from their naturally occurring environment or expression system (e.g., in host cells or in vitro synthesis). Engineered transaminase polypeptides may be present in the cell, in the cell culture medium, or prepared in various forms, such as lysates or isolated preparations. As such, in some embodiments, the engineered transaminase polypeptide may be an isolated polypeptide.

"Chiral center" refers to a carbon atom connecting four different groups.

"Stereoselectivity" refers to the preferential formation of one stereoisomer over the other in a chemical or enzymatic reaction. Stereoselectivity can be partial, with the formation of one stereoisomer is favored over the other; or it may be complete where only one stereoisomer is formed. When the stereoisomers are enantiomers, the stereoselectivity is referred to as enantioselectivity. It is often reported as "enantiomeric excess" (ee for short). The fraction, typically a percentage, is generally reported in the art as the enantiomeric excess (i.e., ee) derived therefrom according to the following formula: [major enantiomer minor enantiomer]/[major enantiomer+minor enantiomer].

"Stereoisomers," "stereoisomeric forms," and similar expressions are used interchangeably herein to refer to all isomers resulting from a difference in orientation of atoms in their space only. It includes enantiomers and compounds that have more than one chiral center and are not mirror images of one another (i.e., diastereomers).

"Improved enzyme properties" refers to an enzyme property that is better or more desirable for a specific purpose as compared to a reference transaminase such as a wild-type transaminase or another improved engineered transaminase. Improved enzyme properties are exhibited by engineered transaminase polypeptides in this disclosure. Enzyme properties that are expected to be improved include, but are not limited to, enzyme activity (which can be expressed as a percentage of substrate conversion), thermal stability, solvent stability, pH activity characteristics, cofactor requirements, tolerance to inhibitors (e.g., substrate or product inhibition), stereospecificity and stereoselectivity.

"Conversion" refers to the enzymatic transformation of a substrate to the corresponding product. "Percent conversion" or "conversion" refers to the percentage of substrate that is converted to product within a period of time under the specified conditions. Thus, "enzymatic activity" or "activity" of a transaminase polypeptide can be expressed as the "percent conversion" of the substrate to the product.

"Thermostable" means that a transaminase polypeptide that retains similar activity (for example more than 50% to 100%)) after being exposed to an elevated temperature (e.g., 30-60° C.) for a period of time (0.5-24 h).

"Solvent-stable" refers to a transaminase polypeptide that maintains similar activity (for example more than 50% to 100%) after exposure to varying solvent (ethanol, isopropanol, dimethylsulfoxide (DMSO), tetrahydrofuran, 2-Methyltetrahydrofuran, acetone, toluene, butyl acetate, methyl tert-butyl ether, etc.) for a period of time (e.g., 0.5-24 h).

"Suitable reaction conditions" refer to those conditions (e.g., enzyme loading, substrate loading, cofactor loading, temperature, pH, buffer, co-solvent, etc.) in the biocatalytic reaction system, under which the transaminase polypeptide of the present disclosure can convert a substrate to a desired product compound. Exemplary "suitable reaction conditions" are provided in the present disclosure and illustrated by examples.

The "amine donor" refers to a compound which can be accepted by a transaminase polypeptide and which can supply an amino group. A typical amine donor includes an amino acid such as alanine, or an amine compound such as isopropylamine.

"Hydrocarbyl" refers to a straight or branched aliphatic hydrocarbon chain. The number of subscripts following the symbol "C" specifies the number of carbon atoms that a particular chain may contain. For example, "$C_1$-$C_8$" refers to a straight or branched chain hydrocarbyl group having 1 to 8 carbon atoms. Hydrocarbyl groups may optionally be substituted with one or more substituent groups. "Aryl" means a monovalent aromatic hydrocarbon group of 6 to about 20 carbon atoms. "Heteroaryl" and "heteroaromatic" refer to an aryl group in which one or more of the carbon atoms of the parent aromatic ring system is/are replaced by a heteroatom (O, N, or S). "Substituted", when used to modify a specified group, means that one or more hydrogen atoms of the specified group are each replaced, independently of one another, by identical or different substituents. "Substituted hydrocarbyl, aryl, or heteroaryl" refers to a hydrocarbyl, aryl, or heteroaryl group in which one or more hydrogen atoms are replaced by other substituents. "Optional" or "optionally" means that the described event or circumstance may or may not occur; for example, "optionally substituted aryl" refers to an aryl group that may or may not be substituted. This description includes both substituted aryl groups and unsubstituted aryl groups.

As used herein, "compound" refers to any compound encompassed by the structural formulas and/or chemical names indicated with the compounds disclosed herein. Compounds may be identified by their chemical structure and/or chemical name. When the chemical structure and chemical name conflict, the chemical structure determines the identity of the compound. Unless specifically stated or indicated otherwise, the chemical structures described herein encompass all possible isomeric forms of the described compounds.

2. Engineered Transaminase

Table 1 below illustrates the engineered transaminase polypeptides developed by the present invention. Each row gives the polynucleotide sequence number and amino acid sequence number of a particular engineered transaminase polypeptide, as well as the residue difference compared to SEQ ID No: 2. The level of catalytic performance of each exemplified engineered transaminase polypeptide (the overall performance in the reaction, combining activity, stability, selectivity, and inhibitory effect of R-PEA) is indicated as "+", with the specific meanings given in Table 2.

TABLE 1

| Polynucleotide SEQ ID No | Amino acid SEQ ID No | Residue difference relative to SEQ ID NO: 2 | Amino acid sequence identity compared SEQ ID No: 2 | Catalytic performance of the to enzyme |
|---|---|---|---|---|
| 1 | 2 | - | 100% | - |
| 3 | 4 | V148L; T187I; L190M; S214C; | 98.8% | + |
| 5 | 6 | L56A; V148L; T187I; L190M; S214C; | 98.5% | + |
| 7 | 8 | V148L; T187I; L190M; S214P; | 98.8% | + |
| 9 | 10 | V148L; T187I; L190M; | 99.1% | + |
| 11 | 12 | V148L; T187I; L190M; S214C; R235E; | 98.5% | + |
| 13 | 14 | V148L; T187I; L190M; S214C; T273S; | 98.5% | + |
| 15 | 16 | V60T; V148L; T187I; L190M; S214P; T273S; A275G; | 97.8% | + |
| 17 | 18 | H53T; V60T; V148L; T187I; L190M; S214P; T273S; | 97.8% | + |
| 19 | 20 | H53T; V60T; F113M; G127F; V148L; T187I; L190M; S214P; T273S; | 97.2% | + |
| 21 | 22 | V60T; V148L; T187I; L190M; S214P; | 98.5% | + |
| 23 | 24 | H53P; V60T; D72G; F113M; V148L; T187I; L190M; S214C; T273S; | 97.2% | + |
| 25 | 26 | V60T; V148L; T187I; L190M; S214P; T273S; | 98.1% | + |
| 27 | 28 | V60T; F113M; V148L; T187I; L190M; S214C; T273S; | 97.8% | + |
| 29 | 30 | V60T; F113M; G127F; V148L; T187I; L190M; S214C; T273S; | 97.5% | + |
| 31 | 32 | H53T; V60T; V148L; T187I; L190M; S214P; T273S; A275G; | 97.5% | + |
| 33 | 34 | F113W; V148L; T187I; L190M; S214C; | 98.5% | + |
| 35 | 36 | S3T; M4I; S9A; L36F; S40Y; D41E; H53A; V60T; S62R; N98K; A101V; F113M; E115K; R126Q; S128R; V148L; N153D; L155S; E159S; L186F; T187I; L190M; M194K; N209H; S214P; I226L; R235E; D244E; I253V; Q262T; S266A; T273S; A275G; Q287K; P312A; G323D; | 88.9% | + |
| 37 | 38 | S3T; M4I; S9A; L36F; S40Y; D41E; H53T; V60T; I61F; N98K; A101V; F113M; E115K; S128R; V148L; N153D; L155S; E159S; L186F; T187N; K188R; L190M; M194K; N209H; S214P; I226L; R235E; D244E; I253V; Q262T; S266A; T273S; A275G; Q287K; P312A; G323D; | 88.9% | + |
| 39 | 40 | S3T; M4I; S9A; L36F; S40Y; D41E; H53R; V60T; S62H; N98K; A101V; F113M; E115K; R126Q; S128R; V148L; N153D; L155S; E159S; T187N; K188R; L190M; M194K; N209H; S214P; I226L; R235E; D244E; I253V; Q262T; S266A; T273S; A275G; Q287K; P312A; G323D; | 88.9% | |
| 41 | 42 | S3T; M4I; S9A; L36F; S40Y; D41E; H53G; V60T; I61F; N98K; A101V; F113M; E115K; V116I; R126Q; S128R; V148L; N153D; L155S; E159S; L186F; T187N; L190M; M194K; N209H; S214P; I226L; R235E; D244E; I253V; Q262T; S266A; T273S; A275G; Q287K; P312A; G323D; | 88.5% | + |
| 43 | 44 | S3T; M4I; S9A; L36F; S40Y; D41E; H53N; V60T; N98K; A101V; F113M; E115K; R126Q; S128R; V148L; N153D; L155S; E159S; L186F; T187I; K188R; L190M; M194K; N209H; S214P; I226L; R235E; D244E; I253V; Q262T; S266A; T273S; A275G; Q287K; P312A; G323D; | 88.9% | + |
| 45 | 46 | S3T; M4I; S9A; L36F; S40Y; D41E; H53T; V60T; I61F; S62H; N98K; A101V; F113M; E115K; V116I; R126Q; S128R; V148L; N153D; L155S; E159S; T187N; L190M; M194K; N209H; S214P; I226L; R235E; D244E; I253V; Q262T; S266A; T273S; A275G; Q287K; P312A; G323D; | 88.5% | + |
| 47 | 48 | S3T; M4I; S9A; L36F; S40Y; D41E; H53T; V60T; S62H; N98K; A101V; F113M; E115K; V116I; S128R; V148L; N153D; L155S; E159S; L186F; T187I; K188R; L190M; M194K; N209H; S214P; I226L; R235E; D244E; I253V; Q262T; S266A; T273S; A275G; Q287K; P312A; G323D; | 88.5% | + |
| 49 | 50 | S3T; M4I; S9A; L36F; S40Y; D41E; H53R; V60T; N98K; A101V; F113M; R126Q; S128R; V148L; N153D; L155S; E159S; L186F; T187N; L190M; M194K; N209H; S214P; I226L; R235E; D244E; I253V; Q262T; S266A; T273S; A275G; Q287K; P312A; G323D; | 89.5% | + |
| 51 | 52 | S3T; M4I; S9A; L36F; S40Y; D41E; H53T; V60T; N98K; A101V; F113M; V116I; R126Q; S128R; V148L; N153D; L155S; E159S; L186F; T187I; L190M; M194K; N209H; S214P; I226L; R235E; D244E; I253V; Q262T; S266A; T273S; A275G; Q287K; P312A; G323D; | 89.2% | + |
| 53 | 54 | S3T; M4I; S9A; L36F; S40Y; D41E; H53T; V60T; I61F; S62N; N98K; A101V; F113M; E115K; S128R; V148L; N153D; L155S; E159S; L186F; T187N; K188R; L190M; M194K; N209H; S214P; I226L; R235E; D244E; I253V; Q262T; S266A; T273S; A275G; Q287K; P312A; G323D; | 88.5% | + |
| 55 | 56 | S3T; M4I; S9A; L36F; S40Y; D41E; H53G; V60T; N98K; A101V; F113M; E115K; V116I; S128R; V148L; N153D; L155S; E159S; L186F; T187I; L190M; M194K; N209H; S214P; I226L; R235E; D244E; I253V; Q262T; S266A; T273S; A275G; Q287K; P312A; G323D; | 89.2% | + |
| 57 | 58 | S3T; M4I; S9A; L36F; S40Y; D41E; H53S; V60T; N98K; A101V; F113M; V114G; E115K; R126Q; S128R; V148L; N153D; L155S; E159S; L186F; T187N; | 88.5% | + |

TABLE 1-continued

| Polynucleotide SEQ ID No | Amino acid SEQ ID No | Residue difference relative to SEQ ID NO: 2 | Amino acid sequence identity compared SEQ ID No: 2 | Catalytic performance of the to enzyme |
|---|---|---|---|---|
| | | K188R; L190M; M194K; N209H; S214P; I226L; R235E; D244E; I253V; Q262T; S266A; T273S; A275G; Q287K; P312A; G323D; | | |
| 59 | 60 | S3T; M4I; S9A; L36F; S40Y; D41E; V60T; N98K; A101V; F113M; E115K; R126Q; S128R; V148L; N153D; L155S; E159S; L186F; T187N; K188R; L190M; M194K; N209H; S214P; I226L; R235E; D244E; I253V; Q262T; S266A; T273S; A275G; Q287K; P312A; G323D; | 89.2% | + |
| 61 | 62 | S3T; M4I; S9A; L36F; S40Y; D41E; H53G; V60T; S62H; N98K; A101V; F113M; V116I; S128R; V148L; N153D; L155S; E159S; L186F; T187N; L190M; M194K; N209H; S214P; I226L; R235E; D244E; I253V; Q262T; S266A; T273S; A275G; Q287K; P312A; G323D; | 89.2% | + |
| 63 | 64 | S3T; M4I; S9A; L36F; S40Y; D41E; H53A; V60T; S62H; N98K; A101V; F113M; V114G; E115K; V116I; S128R; V148L; N153D; L155S; E159S; T187N; K188R; L190M; M194K; N209H; S214P; I226L; R235E; D244E; I253V; Q262T; S266A; T273S; A275G; Q287K; P312A; G323D; | 88.5% | + |
| 65 | 66 | S3T; M4I; S9A; L36F; S40Y; D41E; V60T; I61F; N98K; A101V; F113M; E115K; V116I; R126Q; S128R; V148L; N153D; L155S; E159S; L186F; T187N; K188R; L190M; M194K; N209H; S214P; I226L; R235E; D244E; I253V; Q262T; S266A; T273S; A275G; Q287K; P312A; G323D; | 88.5% | + |
| 67 | 68 | S3T; M4I; S9A; L36F; S40Y; D41E; H53T; V60T; S62H; N98K; A101V; F113M; E115K; S128R; V148L; N153D; L155S; E159S; T187N; K188R; L190M; M194K; N209H; S214P; I226L; R235E; D244E; I253V; Q262T; S266A; T273S; A275G; Q287K; P312A; G323D; | 89.2% | + |
| 69 | 70 | S3T; M4I; S9A; L36F; S40Y; D41E; H53A; V60T; S62N; N98K; A101V; F113M; E115K; S128R; V148L; N153D; L155S; E159S; L186F; T187I; L190M; M194K; N209H; S214P; I226L; R235E; D244E; I253V; Q262T; S266A; T273S; A275G; Q287K; P312A; G323D; | 89.2% | + |
| 71 | 72 | S3T; M4I; S9A; L36F; S40Y; D41E; H53N; V60T; S62N; N98K; A101V; F113M; E115K; V116I; R126Q; S128R; V148L; N153D; L155S; E159S; L186F; T187I; K188R; L190M; M194K; N209H; S214P; I226L; R235E; D244E; I253V; Q262T; S266A; T273S; A275G; Q287K; P312A; G323D; | 88.2% | + |
| 73 | 74 | S3T; M4I; S9A; L36F; S40Y; D41E; V60T; N98K; A101V; F113M; E115K; V116I; S128R; V148L; N153D; L155S; E159S; L186F; T187I; K188R; L190M; M194K; N209H; S214P; I226L; R235E; D244E; I253V; Q262T; S266A; T273S; A275G; Q287K; P312A; G323D; | 89.2% | + |
| 75 | 76 | S3T; M4I; S9A; L36F; S40Y; D41E; H53T; V60T; I61F; N98K; A101V; F113M; E115K; V116I; S128R; V148L; N153D; L155S; E159S; T187I; K188R; L190M; M194K; N209H; S214P; I226L; R235E; D244E; I253V; Q262T; S266A; T273S; A275G; Q287K; P312A; G323D; | 88.9% | + |
| 77 | 78 | S3T; M4I; S9A; L36F; S40Y; D41E; H53S; V60T; I61F; S62H; N98K; A101V; F113M; E115K; V116I; R126Q; S128R; V148L; N153D; L155S; E159S; T187I; K188R; L190M; M194K; N209H; S214P; I226L; R235E; D244E; I253V; Q262T; S266A; T273S; A275G; Q287K; P312A; G323D; | 88.2% | + |
| 79 | 80 | S3T; M4I; S9A; L36F; S40Y; D41E; H53N; V60T; S62N; N98K; A101V; F113M; E115K; V116I; S128R; V148L; N153D; L155S; E159S; L186F; T187I; L190M; M194K; N209H; S214P; I226L; R235E; D244E; I253V; Q262T; S266A; T273S; A275G; Q287K; P312A; G323D; | 88.9% | + |
| 81 | 82 | S3T; M4I; S9A; L36F; S40Y; D41E; H53T; V60T; S62H; N98K; A101V; F113M; R126Q; S128R; V148L; N153D; L155S; E159S; T187N; K188R; L190M; M194K; N209H; S214P; I226L; R235E; D244E; I253V; Q262T; S266A; T273S; A275G; Q287K; P312A; G323D; | 89.2% | + |
| 83 | 84 | S3T; M4I; S9A; L36F; S40Y; D41E; V60T; N98K; A101V; F113M; E115K; V116I; S128R; V148L; N153D; L155S; E159S; T187N; L190M; M194K; N209H; S214P; I226L; R235E; D244E; I253V; Q262T; S266A; T273S; A275G; Q287K; P312A; G323D; | 89.8% | + |
| 85 | 86 | L56A; V60T; F113M; R126N; V148L; T187I; L190M; R235E; T273S; | 97.2% | ++ |
| 87 | 88 | L56A; V60T; F113M; R126D; V148L; T187I; L190M; R235E; T273S; | 97.2% | ++ |
| 89 | 90 | L56A; V60T; F113M; G127K; V148L; T187I; L190M; R235E; T273S; | 97.2% | ++ |
| 91 | 92 | L56A; V60T; F113M; G127S; V148L; T187I; L190M; R235E; T273S; | 97.2% | ++ |
| 93 | 94 | L56A; V60T; F113M; G127P; V148L; T187I; L190M; R235E; T273S; | 97.2% | ++ |
| 95 | 96 | L56A; V60T; F113M; L141Q; V148L; T187I; L190M; R235E; T273S; | 97.2% | ++ |
| 97 | 98 | L56A; V60T; F113M; L141T; V148L; T187I; L190M; R235E; T273S; | 97.2% | ++ |
| 99 | 100 | L56A; V60T; F113M; L143S; V148L; T187I; L190M; R235E; T273S; | 97.2% | ++ |
| 101 | 102 | L56A; V60T; F113M; L143R; V148L; T187I; L190M; R235E; T273S; | 97.2% | ++ |
| 103 | 104 | L56A; V60T; F113M; V148L; T187I; L190M; R235E; T273S; | 97.5% | ++ |
| 105 | 106 | L56A; V60T; F113M; V148L; R167V; T187I; L190M; R235E; T273S; | 97.2% | ++ |
| 107 | 108 | L56A; V60T; F113M; V148L; D175Y; T187I; L190M; R235E; T273S; | 97.2% | ++ |
| 109 | 110 | H53F; L56A; V60T; F113M; V148L; T187I; L190M; R235E; T273S; | 97.2% | ++ |
| 111 | 112 | H53L; L56A; V60T; F113M; V148L; T187I; L190M; R235E; T273S; | 97.2% | ++ |
| 113 | 114 | L56A; D59S; V60T; F113M; V148L; T187I; L190M; R235E; T273S; | 97.2% | ++ |
| 115 | 116 | L56A; D59V; V60T; F113M; V148L; T187I; L190M; R235E; T273S; | 97.2% | ++ |
| 117 | 118 | L56A; D59V; V60T; F113M; V148L; N153D; T187I; L190M; R235E; T273S; D291G; | 96.6% | ++ |
| 119 | 120 | L56A; V60T; S62A; F113M; V148L; T187I; L190M; R235E; T273S; | 97.2% | ++ |
| 121 | 122 | L56A; V60T; F113M; E115H; V148L; T187I; L190M; R235E; T273S; | 97.2% | ++ |

TABLE 1-continued

| Polynucleotide SEQ ID No | Amino acid SEQ ID No | Residue difference relative to SEQ ID NO: 2 | Amino acid sequence identity compared SEQ ID No: 2 | Catalytic performance of the to enzyme |
|---|---|---|---|---|
| 123 | 124 | L56A; V60T; F113M; E115Y; V148L; T187I; L190M; R235E; T273S; | 97.2% | ++ |
| 125 | 126 | L56A; V60T; F113M; E115F; V148L; T187I; L190M; R235E; T273S; | 97.2% | ++ |
| 127 | 128 | L56A; V60T; F113M; V148L; T187I; L190M; R235E; K240D; T273S; | 97.2% | ++ |
| 129 | 130 | L56A; V60T; R86C; F113M; V148L; T187I; L190M; R235E; K240S; T273S; | 96.9% | ++ |
| 131 | 132 | L56A; V60T; F113M; V148L; T187I; L190M; R235E; K240Q; T273S; | 97.2% | ++ |
| 133 | 134 | L56A; V60T; F113M; V148L; F174S; T187I; L190M; R235E; T273S; | 97.2% | ++ |
| 135 | 136 | L56A; D59T; V60T; F113M; V148L; N153D; T187R; L190M; R235E; T273S; D291G; | 96.6% | ++ |
| 137 | 138 | L56A; D59T; V60T; F113M; V148L; N153D; T187I; L190M; M194L; R235E; T273S; D291G; | 96.3% | ++ |
| 139 | 140 | L56A; D59T; V60T; F113M; V148L; N153D; T187I; L190M; M194K; R235E; T273S; D291G; | 96.3% | ++ |
| 141 | 142 | L56A; D59T; V60T; F113M; V148L; N153D; F174I; L181Y; T187I; L190M; R235E; T273S; D291G; | 96.0% | ++ |
| 143 | 144 | L56A; D59T; V60T; F113M; V148L; N153D; L181F; T187I; L190M; R235E; T273S; D291G; | 96.3% | ++ |
| 145 | 146 | L56A; D59T; V60T; F113M; V148L; N153D; T187I; L190M; M194R; R235E; T273S; D291G; | 96.3% | ++ |
| 147 | 148 | L56A; D59T; V60T; F113M; V148L; N153D; T187I; L190M; M194E; R235E; T273S; D291G; | 96.3% | ++ |
| 149 | 150 | L56A; D59T; V60T; F113M; V148L; N153D; T187I; L190M; R235E; D252P; T273S; D291G; | 96.3% | ++ |
| 151 | 152 | L56A; D59T; V60T; I78L; F113M; V148L; N153D; T187I; L190M; R235E; T273S; D291G; | 96.3% | ++ |
| 153 | 154 | L56A; D59T; V60T; F113M; V148L; N153D; T187I; L190M; R235E; T273S; D291G; E307N; | 96.3% | ++ |
| 155 | 156 | L36F; L56A; D59T; V60T; F113M; V148L; N153D; T187I; L190M; R235E; T273S; D291G; | 96.3% | ++ |
| 157 | 158 | L56A; D59T; V60T; A101H; F113M; V148L; N153D; T187I; L190M; R235E; T273S; D291G; | 96.3% | ++ |
| 159 | 160 | L56A; D59T; V60T; F113M; T123S; V148L; N153D; T187I; L190M; R235E; T273S; D291G; | 96.3% | ++ |
| 161 | 162 | L56A; D59T; V60T; F113M; S128N; V148L; N153D; T187I; L190M; R235E; T273S; D291G; | 96.3% | ++ |
| 163 | 164 | L56A; D59T; V60T; F113M; V148L; H156L; T187I; L190M; R235E; T273S; D291G; | 96.6% | ++ |
| 165 | 166 | L56A; D59T; V60T; F113M; V148L; H156I; T187I; L190M; R235E; T273S; D291G; | 96.6% | ++ |
| 167 | 168 | L56A; D59T; V60T; F113M; V148L; N153D; T187I; L190M; N209H; R235E; T273S; D291G; | 96.3% | ++ |
| 169 | 170 | L56A; D59T; V60T; F113M; V148L; N153D; T187I; L190M; R235E; Q262A; T273S; D291G; | 96.3% | ++ |
| 171 | 172 | L56A; D59T; V60T; F113M; V148L; N153D; T187I; L190M; R235E; Q262F; T273S; D291G; | 96.3% | ++ |
| 173 | 174 | L56A; D59T; V60T; F113M; V148L; N153D; T187I; L190M; R235E; S266A; T273S; D291G; | 96.3% | ++ |
| 175 | 176 | L56A; D59T; V60T; F113M; V116I; V148L; N153D; T187I; L190M; R235E; T273S; D291G; | 96.3% | ++ |
| 177 | 178 | L56A; D59T; V60T; N98K; F113M; S128R; K129N; P130V; V148L; N153D; T187I; L190M; N209H; R235E; C272T; T273S; D291G; | 94.7% | ++ |
| 179 | 180 | L56A; D59T; V60T; F113M; S128R; K129Q; P130E; V148L; N153D; T187I; L190M; N209H; R235E; T273S; D291G; P312N; | 95.0% | ++ |
| 181 | 182 | L56A; D59T; V60T; F113M; S128R; K129Q; P130Q; V148L; N153D; T187I; L190M; N209H; R235E; T273S; D291G; P312N; | 95.0% | ++ |
| 183 | 184 | L56A; D59T; V60T; F113M; P130Q; V148L; N153D; T187I; L190M; N209H; R235E; C272T; T273S; D291G; P312N; | 95.4% | ++ |
| 185 | 186 | L56A; D59T; V60T; F113M; S128R; K129N; P130Q; V148L; N153D; T187I; L190M; N209H; R235E; T273S; D291G; P312A; | 95.0% | ++ |
| 187 | 188 | L56A; D59T; V60T; N98K; F113M; S128R; K129Q; P130E; V148L; N153D; T187I; L190M; N209H; R235E; T273S; D291G; P312N; | 94.7% | ++ |
| 189 | 190 | L56A; D59T; V60T; N98K; F113M; K129Q; P130A; V148L; N153D; T187I; L190M; R235E; C272T; T273S; D291G; P312N; | 95.0% | ++ |
| 191 | 192 | L56A; D59T; V60T; N98K; F113M; S128R; K129Q; V148L; N153D; T187I; L190M; N209H; R235E; C272T; T273S; D291G; P312N; | 94.7% | ++ |
| 193 | 194 | L56A; D59T; V60T; N98K; F113M; V148L; N153D; T187I; L190M; R235E; C272T; T273S; D291G; P312N; | 95.7% | ++ |
| 195 | 196 | L56A; D59T; V60T; F113M; V125D; R126W; V148L; N153D; L155I; T187I; L190M; R235E; M271C; T273S; D291G; W302M; | 95.0% | ++ |
| 197 | 198 | E19T; L56A; D59T; V60T; F113M; G124S; V125N; V148L; N153D; L155R; T187I; L190M; R235E; M271C; T273S; I281V; D291G; W302M; | 94.4% | ++ |
| 199 | 200 | L56A; D59T; V60T; F113M; R126W; V148L; N153D; L155R; T187I; L190M; R235E; T273S; D291G; | 96.0% | ++ |
| 201 | 202 | E19A; L56A; D59T; V60T; F113M; G124S; R126W; V148L; N153D; T187I; L190M; R235E; T273S; D291G; W302M; | 95.4% | ++ |

TABLE 1-continued

| Poly-nucleotide SEQ ID No | Amino acid SEQ ID No | Residue difference relative to SEQ ID NO: 2 | Amino acid sequence identity compared SEQ ID No: 2 | Catalytic performance of the to enzyme |
|---|---|---|---|---|
| 203 | 204 | L56A; D59T; V60T; F113M; V148L; N153D; T187I; L190M; F191V; M194E; R235E; T273S; D291G; | 96.0% | +++ |
| 205 | 206 | L56A; D59T; V60T; F113M; V148L; N153D; Q182M; T187I; L190M; M194E; R235E; T273S; D291G; | 96.0% | +++ |
| 207 | 208 | L18H; L56A; D59T; V60T; F113M; V148L; N153D; T187I; L190M; M194E; R235E; T273S; D291G; | 96.0% | +++ |
| 209 | 210 | L18I; L56A; D59T; V60T; F113M; V148L; N153D; T187I; L190M; M194E; R235E; T273S; D291G; | 96.0% | +++ |
| 211 | 212 | Y31W; L56A; D59T; V60T; F113M; V148L; N153D; T187I; L190M; M194E; R235E; T273S; D291G; | 96.0% | +++ |
| 213 | 214 | L56A; D59T; V60T; F113M; L122T; V148L; N153D; T187I; L190M; M194E; R235E; T273S; D291G; | 96.0% | +++ |
| 215 | 216 | L56A; D59T; V60T; I78L; F113M; V148L; N153D; L181F; T187I; L190M; M194E; R235E; T273S; D291G; | 95.7% | +++ |
| 217 | 218 | L56A; D59T; V60T; I78L; F113M; V116I; V148L; N153D; L181F; T187I; L190M; M194E; R235E; Q262A; T273S; D291G; E307N; | 94.7% | +++ |
| 219 | 220 | L36F; L56A; D59T; V60T; I78L; F113M; V116I; S128N; V148L; N153D; T187I; L190M; M194E; N209H; R235E; Q262A; T273S; D291G; E307N; | 94.1% | +++ |
| 221 | 222 | L36F; L56A; D59T; V60T; F113M; V116I; S128N; V148L; N153D; L181F; T187I; L190M; M194E; N209H; R235E; T273S; D291G; E307N; | 94.4% | +++ |
| 223 | 224 | L36F; L56A; D59T; V60T; F113M; V116I; V148L; N153D; L181F; T187I; L190M; M194E; N209H; R235E; T273S; D291G; | 95.0% | +++ |
| 225 | 226 | L56A; D59T; V60T; F113M; V116I; V148L; N153D; L181F; T187I; L190M; M194E; N209H; R235E; Q262A; T273S; D291G; | 95.0% | +++ |
| 227 | 228 | L56A; D59T; V60T; I78L; F113M; V148L; N153D; L181F; T187I; L190M; M194E; N209H; R235E; Q262A; T273S; D291G; | 95.0% | +++ |
| 229 | 230 | L36F; L56A; D59T; V60T; F113M; V116I; S128N; V148L; N153D; L181F; T187I; L190M; M194E; N209H; R235E; Q262A; T273S; D291G; E307N; | 94.1% | +++ |
| 231 | 232 | L36F; L56A; D59T; V60T; F113M; V116I; S128N; V148L; N153D; L181F; T187I; L190M; M194E; R235E; Q262A; T273S; D291G; | 94.7% | +++ |
| 233 | 234 | L36F; L56A; D59T; V60T; I78L; F113M; V116I; V148L; N153D; T187I; L190M; M194E; N209H; R235E; Q262A; T273S; D291G; | 94.7% | +++ |
| 235 | 236 | L36F; L56A; D59T; V60T; I78L; F113M; V148L; N153D; L181F; T187I; L190M; M194E; R235E; Q262A; T273S; D291G; | 95.0% | +++ |
| 237 | 238 | L36F; L56A; D59T; V60T; I78L; F113M; V148L; N153D; L181F; T187I; L190M; M194E; N209H; R235E; Q262A; T273S; D291G; | 94.7% | +++ |
| 239 | 240 | L56A; D59T; V60T; I78L; F113M; V116I; S128N; V148L; N153D; L181F; T187I; L190M; M194E; R235E; T273S; D291G; | 95.0% | +++ |
| 241 | 242 | L56A; D59T; V60T; I78L; F113M; V116I; V148L; N153D; L181F; T187I; L190M; M194E; N209H; R235E; Q262A; T273S; D291G; | 94.7% | +++ |
| 243 | 244 | L36F; L56A; D59T; V60T; I78L; F113M; S128N; V148L; N153D; L181F; T187I; L190M; M194E; R235E; Q262A; T273S; D291G; | 94.7% | +++ |
| 245 | 246 | L56A; D59T; V60T; I78L; F113M; V116I; V148L; N153D; L181F; T187I; L190M; M194E; N209H; R235E; T273S; D291G; | 95.0% | +++ |
| 247 | 248 | L36F; L56A; D59T; V60T; I78L; F113M; V116I; V148L; N153D; L181F; T187I; L190M; M194E; R235E; Q262A; T273S; D291G; E307N; | 94.4% | +++ |
| 249 | 250 | L56A; D59T; V60T; I78L; F113M; V116I; S128N; V148L; N153D; T187I; L190M; M194E; R235E; Q262A; T273S; D291G; | 95.0% | +++ |
| 251 | 252 | L36F; L56A; D59T; V60T; F113M; V116I; S128N; V148L; N153D; L181F; T187I; L190M; M194E; R235E; T273S; D291G; | 95.0% | +++ |
| 253 | 254 | L36F; L56A; D59T; V60T; I78L; F113M; S128N; V148L; N153D; L181F; T187I; L190M; M194E; R235E; T273S; D291G; | 95.0% | +++ |
| 255 | 256 | L56A; D59T; V60T; F113M; V148L; N153D; T187I; L190M; M194E; R235E; S266A; T273S; D291G; | 96.0% | +++ |
| 257 | 258 | L56A; D59T; V60T; S62A; A101H; F113M; E115H; V148L; N153D; T187I; L190M; M194E; R235E; S266A; T273S; D291G; | 95.0% | +++ |
| 259 | 260 | L56A; D59T; V60T; S62A; A101H; F113M; V148L; N153D; T187I; L190M; M194E; R235E; T273S; D291G; | 95.7% | +++ |
| 261 | 262 | L56A; D59T; V60T; S62A; F113M; V148L; N153D; T187I; L190M; M194E; R235E; S266A; T273S; D291G; | 95.7% | +++ |
| 263 | 264 | L56A; D59T; V60T; I78L; F113M; T123S; R126G; V148L; N153D; T187I; L190M; M194E; R235E; T273S; D291G; | 95.4% | +++ |
| 265 | 266 | L56A; D59T; V60T; I78L; F113M; T123S; R126G; G127K; V148L; N153D; T187I; L190M; M194E; R235E; T273S; D291G; | 95.0% | +++ |
| 267 | 268 | L56A; D59T; V60T; I78L; F113M; R126D; G127K; V148L; N153D; T187I; L190M; M194E; R235E; T273S; D291G; | 95.4% | +++ |
| 269 | 270 | L56A; D59T; V60T; I78L; F113M; T123S; R126G; G127K; S128N; V148L; N153D; T187I; L190M; M194E; R235E; T273S; D291G; | 94.7% | +++ |
| 271 | 272 | L56A; D59T; V60T; I78L; F113M; T123S; R126H; V148L; N153D; T187I; L190M; M194E; R235E; T273S; D291G; | 95.4% | +++ |
| 273 | 274 | L56A; D59T; V60T; F113M; V148L; N153D; L181F; Q182M; T187I; L190M; M194E; R235E; T273S; D291G; | 95.7% | +++ |
| 275 | 276 | L56A; D59T; V60T; F113M; V148L; N153K; T187I; L190M; M194E; R235E; T273S; D291G; | 96.3% | ++++ |

TABLE 1-continued

| Poly-nucleotide SEQ ID No | Amino acid SEQ ID No | Residue difference relative to SEQ ID NO: 2 | Amino acid sequence identity compared SEQ ID No: 2 | Catalytic performance of the to enzyme |
|---|---|---|---|---|
| 277 | 278 | L56A; D59T; V60T; F113M; V148L; N153D; T187I; L190M; M194E; V219I; R235E; T273S; D291G; | 96.0% | ++++ |
| 279 | 280 | L56A; D59T; V60T; F113M; V148L; N153D; T187I; L190M; M194E; V219L; R235E; T273S; D291G; | 96.0% | ++++ |
| 281 | 282 | L56A; D59T; V60T; F113M; V148L; H156R; T187I; L190M; M194E; R235E; T273S; D291G; | 96.3% | ++++ |
| 283 | 284 | S40T; L56A; D59T; V60T; F113M; V148L; N153D; T187I; L190M; M194E; R235E; T273S; D291G; | 96.0% | ++++ |
| 285 | 286 | L56A; D59T; V60T; F113M; V148L; N153D; T187I; L190M; M194E; R235E; I243F; T273S; D291G; | 96.0% | ++++ |
| 287 | 288 | L56A; D59T; V60T; F113M; V148L; N153D; T187I; L190M; M194E; R235E; T273S; I278V; D291G; | 96.0% | ++++ |
| 289 | 290 | L56A; D59T; V60T; F113M; V148L; N153D; I162V; T187I; L190M; M194E; R235E; T273S; D291G; | 96.0% | ++++ |
| 291 | 292 | L56A; D59T; V60T; F113M; V148L; N153D; T187I; L190M; M194E; I226L; R235E; T273S; D291G; | 96.0% | ++++ |
| 293 | 294 | L56A; D59T; V60T; I78L; N98K; F113M; G124S; V125N; S128R; K129Q; V148L; N153D; L155R; T187I; L190M; M194E; N209H; S214P; I226L; R235E; D244E; I253V; Q262T; S266A; C272T; T273S; I281V; D291G; P312N; | 91.0% | ++++ |
| 295 | 296 | L56A; D59T; V60T; I78L; N98K; F113M; G124S; S128R; K129Q; V148L; N153D; L155R; L181F; T187I; L190M; M194E; N209H; R235E; C272T; T273S; D291G; P312N; | 93.2% | ++++ |
| 297 | 298 | L56A; D59T; V60T; N98K; F113M; S128R; K129Q; V148L; N153D; T187I; L190M; N209H; R235E; C272T; T273S; D291G; W302M; P312N; | 94.4% | ++++ |
| 299 | 300 | L56A; D59T; V60T; I78L; N98K; F113M; T123I; G124S; V125N; S128R; K129Q; V148L; N153D; L155R; L181F; T187I; L190M; M194E; N209H; R235E; C272T; T273S; Q287K; P312N; | 92.6% | ++++ |
| 301 | 302 | L56A; D59T; V60T; I78L; N98K; F113M; S128R; K129Q; V148L; N153D; L181F; T187I; L190M; M194E; N209H; R235E; C272T; T273S; I281V; W302M; P312N; | 93.5% | ++++ |
| 303 | 304 | L56A; D59T; V60T; I78L; N98K; F113M; G124S; S128R; K129Q; V148L; N153D; L181F; T187I; L190M; M194E; N209H; R235E; C272T; T273S; D291G; W302M; P312N; | 93.2% | ++++ |
| 305 | 306 | L56A; D59T; V60T; I78L; N98K; F113M; G124S; S128R; K129Q; V148L; N153D; L181F; T187I; L190M; M194E; N209H; R235E; C272T; T273S; D291G; P312N; G323D; | 93.2% | ++++ |
| 307 | 308 | L56A; D59T; V60T; N98K; F113M; S128R; K129Q; V148L; N153D; L155R; L181F; T187I; L190M; M194E; N209H; R235E; C272T; T273S; D291G; P312N; | 93.8% | ++++ |
| 309 | 310 | L56A; D59T; V60T; N98K; F113M; V125N; S128R; K129Q; V148L; N153D; L155R; L181F; T187I; L190M; M194E; N209H; R235E; C272T; T273S; D291G; P312A; G323D; | 93.2% | ++++ |
| 311 | 312 | L47P; G50A; L56A; D59T; V60T; F113M; V148L; N153D; T187I; L190M; M194E; R235E; T273S; D291G; | 95.7% | ++++ |
| 313 | 314 | L56A; D59T; V60T; I78L; N98K; F113M; S128R; K129Q; V148L; N153D; L181F; T187I; L190M; M194E; N209H; R235E; C272T; T273S; D291G; W302M; P312N; | 93.5% | ++++ |
| 315 | 316 | L56A; D59T; V60T; I78L; N98K; F113M; G124S; V125N; S128R; K129Q; V148L; N153D; L155R; L181F; T187I; L190M; M194E; N209H; R235E; C272T; T273S; D291G; W302M; P312N; | 92.6% | ++++ |
| 317 | 318 | L56A; D59T; V60T; I78L; N98K; F113M; G124S; V125N; S128R; K129Q; V148L; N153D; L155R; L181F; T187I; L190M; N209H; R235E; C272T; T273S; D291G; P312N; | 93.2% | ++++ |
| 319 | 320 | L56A; D59T; V60T; I78L; N98K; F113M; G124S; S128R; K129Q; V148L; N153D; L155R; T187I; L190M; M194E; N209H; R235E; C272T; T273S; D291G; P312A; G323D; | 93.2% | ++++ |
| 321 | 322 | L56A; D59T; V60T; N98K; F113M; V125N; S128R; K129Q; V148L; N153D; L181F; T187I; L190M; M194E; N209H; R235E; C272T; T273S; D291G; P312N; | 93.8% | ++++ |
| 323 | 324 | L36F; L56A; D59T; V60T; N98K; F113M; G124S; S128R; K129Q; V148L; N153D; L181F; T187I; L190M; M194E; N209H; R235E; Q262A; C272T; T273S; D291G; E307N; P312N; | 92.9% | ++++ |
| 325 | 326 | L56A; D59T; V60T; N98K; F113M; V116I; G124S; S128R; K129Q; V148L; N153D; T187I; L190M; N209H; R235E; Q262A; C272T; T273S; D291G; P312N; | 93.8% | ++++ |
| 327 | 328 | L36F; L56A; D59T; V60T; N98K; F113M; V116I; G124S; S128R; K129Q; V148L; N153D; L155R; L181F; T187I; L190M; M194E; N209H; R235E; Q262A; C272T; T273S; I281V; D291G; P312N; | 92.3% | ++++ |
| 329 | 330 | L56A; D59T; V60T; N98K; F113M; V116I; V125N; S128R; K129Q; V148L; N153D; L155R; T187I; L190M; N209H; R235E; Q262A; C272T; T273S; D291G; P312N; | 93.5% | ++++ |
| 331 | 332 | L36F; L56A; D59T; V60T; I78L; N98K; F113M; S128R; K129Q; V148L; N153D; L181F; T187I; L190M; M194E; N209H; R235E; Q262A; C272T; T273S; D291G; E307N; P312N; | 92.9% | ++++ |

TABLE 1-continued

| Poly-nucleotide SEQ ID No | Amino acid SEQ ID No | Residue difference relative to SEQ ID NO: 2 | Amino acid sequence identity compared SEQ ID No: 2 | Catalytic performance of the to enzyme |
|---|---|---|---|---|
| 333 | 334 | L56A; D59T; V60T; N98K; F113M; G124S; S128R; K129Q; V148L; N153D; L181F; T187I; L190M; M194E; N209H; R235E; C272T; T273S; D291G; P312N; | 93.8% | ++++ |
| 335 | 336 | L56A; D59T; V60T; I78L; N98K; F113M; V116I; G124S; S128R; K129Q; V148L; N153D; L155R; L181F; T187I; L190M; N209H; R235E; Q262A; C272T; T273S; D291G; E307N; P312N; | 92.6% | ++++ |
| 337 | 338 | L36F; L56A; D59T; V60T; I78L; N98K; F113M; V116I; V125N; S128R; K129Q; V148L; N153D; L181F; T187I; L190M; M194E; N209H; R235E; Q262A; C272T; T273S; D291G; W302M; P312N; | 92.3% | ++++ |
| 339 | 340 | L56A; D59T; V60T; I78L; N98K; F113M; V116I; V125N; S128R; K129Q; V148L; N153D; L181F; T187I; L190M; M194E; N209H; R235E; Q262A; C272T; T273S; D291G; P312N; | 92.9% | ++++ |
| 341 | 342 | L56A; D59T; V60T; I78L; N98K; F113M; V116I; G124S; V125N; S128R; K129Q; V148L; N153D; L155R; T187I; L190M; M194E; N209H; R235E; Q262A; M271C; C272T; T273S; Q287K; P312N; | 92.3% | ++++ |
| 343 | 344 | L36F; L56A; D59T; V60T; N98K; F113M; S128R; K129Q; V148L; N153D; L181F; T187I; L190M; M194E; N209H; R235E; C272T; T273S; D291G; P312N; | 93.8% | ++++ |
| 345 | 346 | L56A; D59T; V60T; I78L; N98K; F113M; S128R; K129Q; V148L; N153D; L155R; L181F; T187I; L190M; M194E; N209H; R235E; C272T; T273S; D291G; E307N; P312N; | 93.2% | ++++ |
| 347 | 348 | L36F; L56A; D59T; V60T; I78L; N98K; F113M; V116I; V125N; S128R; K129Q; V148L; N153D; T187I; L190M; M194E; N209H; R235E; Q262A; C272T; T273S; D291G; P312N; | 92.9% | ++++ |
| 349 | 350 | L36F; L56A; D59T; V60T; I78L; N98K; F113M; G124S; S128R; K129Q; V148L; N153D; L155R; L181F; T187I; L190M; M194E; N209H; R235E; C272T; T273S; D291G; E307N; P312N; | 92.6% | ++++ |
| 351 | 352 | L36F; L56A; D59T; V60T; I78L; N98K; F113M; V116I; S128R; K129Q; V148L; N153D; L155R; L181F; T187I; L190M; N209H; R235E; Q262A; C272T; T273S; D291G; P312N; | 92.9% | ++++ |
| 353 | 354 | L56A; D59T; V60T; I78L; N98K; F113M; V116I; G124S; S128R; K129Q; V148L; N153D; L155R; L181F; T187I; L190M; M194E; N209H; R235E; Q262A; C272T; T273S; D291G; E307N; P312N; | 92.3% | ++++ |
| 355 | 356 | L36F; L56A; D59T; V60T; I78L; N98K; F113M; V116I; S128R; K129Q; V148L; N153D; L155R; L181F; T187I; M194E; T199K; N209H; R235E; Q262A; C272T; T273S; D291G; P312N; | 92.6% | +++++ |
| 357 | 358 | L36F; L56A; D59T; V60T; I78L; N98K; F113M; V116I; S128R; K129Q; V148L; N153D; L155R; L181F; T187I; L190M; M194E; T199Q; N209H; R235E; Q262A; C272T; T273S; D291G; P312N; | 92.3% | +++++ |
| 359 | 360 | L36F; L56A; D59T; V60T; I78L; N98K; F113M; V116I; S128R; K129Q; V148L; N153D; L155R; L181F; T187I; L190M; M194K; T199E; N209H; R235E; Q262A; C272T; T273S; D291G; P312N; | 92.3% | +++++ |
| 361 | 362 | L36F; L56A; D59T; V60T; I78L; N98K; F113M; V116I; S128R; K129Q; V148L; N153D; L155R; L181F; T187I; M194K; T199E; N209H; R235E; Q262A; C272T; T273S; D291G; P312N; | 92.6% | +++++ |
| 363 | 364 | L36F; L56A; D59T; V60T; I78L; N98K; F113M; V116I; S128R; K129Q; V148L; N153D; L155R; L181F; T187I; L190M; M194N; T199E; N209H; R235E; Q262A; C272T; T273S; D291G; P312N; | 92.3% | +++++ |
| 365 | 366 | L36F; L56A; D59T; V60T; I78L; N98K; F113M; V116I; S128R; K129Q; V148L; N153D; L155R; L181F; T187I; L190M; M194K; T199N; N209H; R235E; Q262A; C272T; T273S; D291G; P312N; | 92.3% | +++++ |
| 367 | 368 | L36F; L56A; D59T; V60T; I78L; N98K; F113M; V116I; S128R; K129Q; V148L; N153D; L155R; L181F; T187I; L190M; M194V; T199Q; N209H; R235E; Q262A; C272T; T273S; D291G; P312N; | 92.3% | +++++ |
| 369 | 370 | L36F; L56A; D59T; V60T; I78L; N98K; F113M; V116I; S128R; K129Q; V148L; N153D; L155R; L181F; T187I; L190M; M194E; N209H; R235E; Q262A; C272T; T273S; D291G; P312N; | 92.6% | +++++ |
| 371 | 372 | L36F; L56A; D59T; V60T; I78L; N98K; F113M; V116I; S128R; K129Q; V148L; N153D; L155R; L181F; T187I; L190M; M194V; T199E; N209H; R235E; Q262A; C272T; T273S; D291G; P312N; | 92.3% | +++++ |
| 373 | 374 | L36F; L56A; D59T; V60T; I78L; N98K; F113M; V116I; S128R; K129Q; V148L; N153D; L155R; L181F; T187I; L190M; M194D; T199Q; N209H; R235E; Q262A; C272T; T273S; D291G; P312N; | 92.3% | +++++ |
| 375 | 376 | L36F; L56A; D59T; V60T; I78L; N98K; F113M; V116I; S128R; K129Q; V148L; N153D; L155R; L181F; T187I; L190M; M194V; T199K; N209H; R235E; Q262A; C272T; T273S; D291G; P312N; | 92.3% | +++++ |
| 377 | 378 | L36F; L56A; D59T; V60T; I78L; N98K; F113M; V116I; S128R; K129Q; V148L; N153D; L155R; L181F; T187I; L190M; M194K; N209H; R235E; Q262A; C272T; T273S; D291G; P312N; | 92.6% | +++++ |
| 379 | 380 | L36F; L56A; D59T; V60T; I78L; N98K; F113M; V116I; S128R; K129Q; V148L; N153D; L155R; L181F; T187I; L190M; M194I; T199K; N209H; R235E; Q262A; C272T; T273S; D291G; P312N; | 92.3% | +++++ |

TABLE 1-continued

| Poly-nucleotide SEQ ID No | Amino acid SEQ ID No | Residue difference relative to SEQ ID NO: 2 | Amino acid sequence identity compared SEQ ID No: 2 | Catalytic performance of the to enzyme |
|---|---|---|---|---|
| 381 | 382 | L36F; L56A; D59T; V60T; I78L; N98K; F113M; V116I; S128R; K129Q; V148L; N153D; L155R; L181F; T187I; M194D; T199Q; N209H; R235E; Q262A; C272T; T273S; D291G; P312N; | 92.6% | +++++ |
| 383 | 384 | L36F; H53R; L56V; D59T; V60T; I78L; N98K; F113M; V116I; S128R; K129Q; V148L; N153D; L155R; L181F; L186F; L190M; N209H; R235E; Q262A; C272T; T273S; D291G; P312N; | 92.6% | +++++ |
| 385 | 386 | L36F; H53R; L56S; D59T; V60T; I78L; N98K; F113M; V116I; S128R; K129Q; V148L; N153D; L155R; L181F; L190M; N209H; R235E; Q262A; C272T; T273S; D291G; P312N; | 92.9% | +++++ |
| 387 | 388 | L36F; H53R; L56V; D59T; V60T; I78L; N98K; F113M; V116I; S128R; K129Q; V148L; N153D; L155R; L181F; L190M; N209H; R235E; Q262A; C272T; T273S; D291G; P312N; | 92.9% | +++++ |
| 389 | 390 | L36F; S54A; L56A; D59T; V60T; I78L; N98K; F113M; V116I; S12813; K129Q; V148L; N153D; L155R; L181F; T187I; L190M; N209H; R235E; Q262A; C272T; T273S; D291G; P312N; | 92.6% | +++++ |
| 391 | 392 | L36F; L56A; D59T; V60T; I78L; N98K; F113M; V116I; S128R; K129Q; V148L; N153D; L155R; L181F; T187I; L190M; M194G; N209H; R235E; Q262A; C272T; T273S; D291G; P312N; | 92.6% | +++++ |
| 393 | 394 | L36F; L56A; D59T; V60T; I78L; N98K; F113M; V116I; S128R; K129Q; V148L; N153D; L155R; D175G; L181F; T187I; L190M; N209H; R235E; Q262A; C272T; T273S; D291G; P312N; | 92.6% | +++++ |
| 395 | 396 | L36F; L56A; D59T; V60T; I78L; N98K; F113M; V116I; S128R; K129Q; V148L; N153D; L155R; A173D; L181F; T187I; L190M; N209H; R235E; Q262A; C272T; T273S; D291G; P312N; | 92.6% | +++++ |

TABLE 2

| Representative symbol | Description of improved catalytic performance of engineered transaminase polypeptide (Measured by the conversion of substrate A1) | Reaction condition for conversion measurement |
|---|---|---|
| + | ≥2 times the conversion of SEQ ID No: 2 | Substrate A1 5 g/L, enzyme powder 10 g/L, 0.5M-2.0M isopropylamine, 10% (v/v) methanol, pH 9.0, 40° C. |
| ++ | ≥10 times the conversion of SEQ ID No: 2 | Substrate A1 5 g/L, enzyme powder 5 g/L, 0.5M-2.0M isopropylamine, 10% (v/v) methanol, pH 9.0, 40° C. |
| +++ | ≥100 times the conversion of SEQ ID No: 2 | Substrate A1 50 g/L, enzyme powder 5 g/L, 0.5M-2.0M isopropylamine, 10% (v/v) methanol, pH 9.0, 40° C. |
| ++++ | ≥200 times the conversion of SEQ ID No: 2 | Substrate A1 50 g/L, enzyme powder 5 g/L, 0.5M-2.0M isopropylamine, 20% (v/v) methanol, pH 9.0, 40° C. |
| +++++ | ≥500 times the conversion of SEQ ID No: 2 | Substrate A1 50 g/L, enzyme powder 5 g/L, 0.5M-2.0M isopropylamine, 30% (v/v) methanol, pH 9.0, 40° C. |

The amino acid sequences listed in Table 1 (i.e., even sequence identifiers of SEQ ID NO: 2 to 396) each contain 323 amino acid residues. The amino acid sequences of SEQ ID NO: 398 or SEQ ID NO: 400 has a different number of amino acids caused by of deletion and substitution of amino acid residues as compared to SEQ ID No: 2, the engineered transaminase polypeptides represented by SEQ ID NO: 398 or SEQ ID NO: 400 exhibit better catalytic performance, whose conversion is at least 500 times higher than that of SEQ ID No: 2 under the reaction condition of "+++++" shown in Table 2. The enzyme powders described in Table 2 contain equal amount of engineered transaminase polypeptides per unit weight.

3. Polynucleotides, Control Sequences, Expression Vectors and Host Cells that can be Used to Produce Engineered Transaminase Polypeptides In another aspect, this disclosure provides polynucleotides encoding engineered polypeptides having transaminase activity described herein. The polynucleotides can be linked to one or more heterologous regulatory sequences that control gene expression to produce recombinant polynucleotides that are capable of expressing the engineered polypeptides. Expression constructs comprising a heterologous polynucleotide encoding an engineered transaminase may be introduced into a suitable host cell to express the corresponding engineered transaminase polypeptide. As apparent to one skilled in the art, the availability of protein sequences and knowledge of codons corresponding to a variety of amino acids provide an illustration of all possible polynucleotides that encode the protein sequence of interest. The degeneracy of the genetic code, in which the same amino acid is encoded by selectable or synonymous codons, allows for the production of an extremely large number of polynucleotides, all of which encode the engineered transaminase polypeptides disclosed herein. Thus, upon determination of a particular amino acid sequence, one skilled in the art can generate any number of different polynucleotides by merely modifying one or more codons in a manner that does not alter the amino acid sequence of the protein. In this regard, this disclosure specifically contemplates each and every possible alteration of a polynucleotide that can be made by selecting a combination based on possible codon selections, for any of the polypeptides disclosed herein, comprising those amino acid sequences of exemplary engineered polypeptides listed in Table 1, and any of the polypeptides disclosed as even sequence identifiers of SEQ ID NO: 4 to 400 in the Sequence Listing incorporated by reference, all of which are believed to be particularly disclosed or public.

In various embodiments, the codons are preferably selected to accommodate the host cell in which the recombinant protein is produced. For example, codons preferred for bacteria are used to express genes in bacteria; codons preferred for yeast are used to express genes in yeast; and codons preferred for mammals are used for gene expression in mammalian cells.

In some embodiments, the polynucleotides encode polypeptides comprising amino acid sequences that are at least about 80%, 85%, 86%, 87%, 88%, 89%, 90%, 91%, 92%, 93%, 94%, 95%, 96%, 97%, 98%, 99% or more identical to a reference sequence that is an even sequence identifier of SEQ ID NO: 4-400, wherein the polypeptides have transaminase activity and one or more of the improved properties described herein, for example, the ability of converting compound A1 to compound A2 with increased activity compared to the polypeptide of SEQ ID NO: 2.

In some embodiments, the polynucleotides encode engineered transaminase polypeptides comprising amino acid sequences having a percentage of identity described above and having one or more amino acid residue differences as compared to SEQ ID NO: 2. In some embodiments, the present disclosure provides engineered polypeptides having transaminase activity, wherein the engineered polypeptides comprise a combination that has at least 80% sequence identity to the reference sequence of SEQ ID NO: 2 with residue differences that is selected from the following positions: X3, X4, X9, X18, X19, X31, X36, X40, X41, X47, X50, X53, X54, X56, X59, X60, X61, X62, X72, X78, X86, X98, X101, X113, X114, X115, X116, X122, X123, X124, X125, X126, X127, X128, X129, X130, X141, X143, X148, X153, X155, X156, X159, X162, X167, X173, X174, X175, X181, X182, X186, X187, X188, X190, X191, X194, X199, X209, X214, X219, X226, X235, X240, X243, X244, X252, X253, X262, X266, X271, X272, X273, X275, X278, X281, X287, X291, X302, X307, X312, X323.

In some embodiments, the polynucleotides encoding the engineered transaminase polypeptides comprise sequences having odd sequence identifiers of SEQ ID NOs: 3-399.

In some embodiments, the polynucleotides encode polypeptides as described herein, but at the nucleotide level, the polynucleotides have about 50%, 55%, 60%, 65%, 70%, 75%, 80%, 85%, 86%, 87%, 88%, 89%, 90%, 91%, 92%, 93%, 94%, 95%, 96%, 97%, 98%, 99% or more sequence identity to reference polynucleotides encoding engineered transaminase polypeptides as described herein. In some embodiments, the reference polynucleotides are selected from the sequences having the odd sequence identifiers of SEQ ID NO: 3-399.

The isolated polynucleotides encoding engineered transaminase polypeptides can be manipulated to enable the expression of the engineered polypeptides in a variety of ways, which comprises further modification of the sequences by codon optimization to improve expression, insertion into suitable expression elements with or without additional control sequences, and transformation into a host cell suitable for expression and production of the engineered polypeptides.

Depending on the expression vector, manipulation of the isolated polynucleotide prior to insertion of the isolated polynucleotide into the vector may be desirable or necessary. Techniques for modifying polynucleotides and nucleic acid sequences using recombinant DNA methods are well known in the art. Guidance is provided below: Sambrook et al., 2001, Molecular Cloning: A Laboratory Manual, Third Edition, Cold Spring Harbor Laboratory Press; and Current Protocols in Molecular Biology, Edited by Ausubel. F. et al., ISBN: 978-0-471-50338-5.

In another aspect, this disclosure also relates to recombinant expression vectors, depending on the type of host they are to be introduced into, including a polynucleotide encoding an engineered transaminase polypeptide or variant thereof, and one or more expression regulatory regions, such as promoters and terminators, origin of replication and the like. Alternatively, the nucleic acid sequence of the present disclosure can be expressed by inserting the nucleic acid sequence or the nucleic acid construct comprising the sequence into an appropriate expression vector. In generating the expression vector, the coding sequence is located in the vector such that the coding sequence is linked to a suitable control sequence for expression.

The recombinant expression vector can be any vector (e.g., a plasmid or virus) that can be conveniently used in recombinant DNA procedures and can result in the expression of a polynucleotide sequence. The choice of vector will generally depend on the compatibility of the vector with the host cell to be introduced into. The vector can be linear or closed circular plasmid. The expression vector may be an autonomously replicating vector, i.e., a vector that exists as an extrachromosomal entity whose replication is independent of chromosomal replication such as plasmids, extrachromosomal elements, minichromosomes, or artificial chromosomes. The vector may contain any tools for ensuring self-copying. Alternatively, the vector may be a vector that, when introduced into a host cell, integrates into the genome and replicates with the chromosome into which it is integrated. Moreover, a single vector or plasmid or two or more vectors or plasmids that together comprise the total DNA to be introduced into the genome of the host cell may be used.

Many expression vectors useful to the embodiments of the present disclosure are commercially available. An exemplary expression vector can be prepared by inserting a polynucleotide encoding an engineered transaminase polypeptide to plasmid pACYC-Duet-1 (Novagen).

In another aspect, this disclosure provides host cells comprising polynucleotides encoding engineered transaminase polypeptides of the present disclosure. The polynucleotide is linked to one or more control sequences for expression of transaminase polypeptides in a host cell. Host cells for expression of polypeptides encoded by the expression vectors of the present disclosure are well known in the art, including, but not limited to, bacterial cells such as *E. coli*, *Arthrobacter* KNK168, *Streptomyces*, and *Salmonella typhimurium* cells; fungal cells such as yeast cells (e.g., *Saccharomyces cerevisiae* or *Pichia pastoris*); insect cells such as *Drosophila* S2 and *Spodoptera* Sf9 cells; animal cells such as CHO, COS, BHK, 293 and Bowes melanoma cells; and plant cells. An exemplary host cell is *E. coli* BL21 (DE3). The above host cells may be wild-type or may be engineered cells through genomic edition, such as knockout of the wild-type transaminase gene carried in the host cell's genome. Suitable media and growth conditions for the above host cells are well known in the art.

Polynucleotides used to express engineered transaminases can be introduced into cells by a variety of methods known in the art. Techniques comprise, among others, electroporation, bio-particle bombardment, liposome-mediated transfection, calcium chloride transfection, and protoplast fusion. Different methods of introducing polynucleotides into cells are obvious to those skilled in the art.

4. Process of Producing an Engineered Transaminase Gob/Peptide

Engineered transaminase can be developed by subjecting a polynucleotide encoding a transaminase to mutagenesis and/or directed evolution. An illustration of direction evolution technique can be found in "Biocatalysis for the Pharmaceutical Industry: Discovery, Development, and Manufacturing" (2009 John Wiley & Sons Asia (Pte) Ltd. ISBN: 978-0-470-82314-9).

When the sequence of an engineered polypeptide is known, the encoding polynucleotide may be prepared by standard solid-phase methods according to known synthetic methods. In some embodiments, fragments of up to about 100 bases can be synthesized separately and then ligated (e.g., by enzymatic or chemical ligation methods or polymerase-mediated methods) to form any desired contiguous sequence. For example, the polynucleotides and oligonucleotides of the present disclosure can be prepared by chemical synthesis using, for example, the classic phosphoramidite methods described by Beaucage et al., 1981, Tet Lett 22: 1859-69, or Matthes et al. People, 1984, EMBO J. 3: 801-05, as typically practiced in automated synthesis methods. According to the phosphoramidite method, oligonucleotides are synthesized, purified, annealed, ligated, and cloned into a suitable vector, for example, in an automated DNA synthesizer. In addition, essentially any nucleic acid is available from any of a variety of commercial sources.

In some embodiments, the present disclosure also provides a process for preparing or producing an engineered transaminase polypeptide, wherein the process comprises culturing a host cell capable of expressing a polynucleotide encoding an engineered polypeptide under culture conditions suitable for the expression of the polypeptide. In some embodiments, the process of preparing a polypeptide further comprises isolating the polypeptide. Engineered polypeptides may be expressed in suitable cells and isolated (or recovered) from the host cell and/or culture medium using any one or more of the well-known techniques for protein purification, the techniques for protein purification include, among others, lysozyme treatment, sonication, filtration, salting out, ultracentrifugation and chromatography.

5. Methods of Using an Engineered Transaminase and Compounds Prepared Therewith In another aspect, the engineered transaminase polypeptides described herein can convert a ketone compound to a chiral amine compound in the presence of an amine donor. The present disclosure also provides process of preparing a wide range of compounds (I) or structural analogs thereof using an engineered transaminase polypeptide disclosed herein. In some embodiments, engineered transaminase polypeptides can be used in a process of preparing a compound of formula (I):

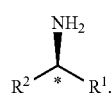

The amine product of formula (I) has the indicated stereochemical configuration at the chiral center marked with an *; the amine product of formula (I) is in enantiomer excess over the other isomer, wherein $R^1$ is optionally substituted or unsubstituted aryl or heteroaryl, or optionally substituted or unsubstituted $C_1$-$C_8$ hydrocarbyl; or it may be

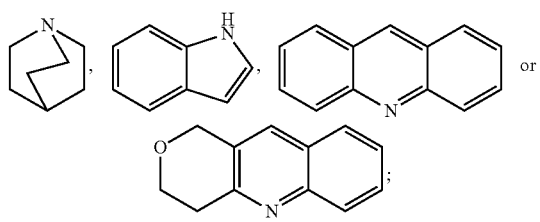

$R^2$ is optionally substituted or unsubstituted $C_1$-$C_6$ hydrocarbyl, halogen (such as —F, —Cl, —Br, and —I), —NO$_2$, —NO, —SO$_2$R' or —SOR', —SR', —NR'R', —OR', —CO$_2$R' or —COR', —C(O)NR', —SO$_2$NH$_2$ or —SONH$_2$, —CN, CF$_3$; wherein each R' is independently selected from —H or ($C_1$-$C_4$) hydrocarbyl. The process herein comprises that, under reaction conditions suitable for converting the ketone substrate to an amine product, the ketone substrate of formula (II):

and the amine donor are contacted with a transaminase polypeptide, wherein the transaminase polypeptide is an engineered transaminase polypeptide as described herein.

In some embodiments, the engineered transaminase polypeptide has at least 80%, 85%, 86%, 87%, 88%, 89%, 90%, 91%, 92%, 93%, 94%, 95%, 96%, 97%, 98%, 99% or more of sequence identity with SEQ ID NO:2, and are capable of converting a compound of formula (II) to a compound of formula (I) with a higher conversion than SEQ ID NO: 2.

In some embodiments, the chiral amine product of formula (I) is present in an enantiomeric excess of at least 60%, 65%, 70%, 75%, 80%, 85%, 90%, 91%, 92%, 93%, 94%, 95%, 96%, 97%, 98% or 99% or more.

As noted above, transaminase polypeptides useful in the process of the present disclosure may be characterized according to the ability of converting acetophenone to R-PEA. Thus, in any of the embodiments of the process disclosed herein, the process may be carried out, wherein the transaminase polypeptides are capable of converting acetophenone to R-PEA with better catalytic performance than SEQ ID NO: 2, and have at least 80%, 85%, 86%, 87%, 88%, 89%, 90%, 91%, 92%, 93%, 94%, 95%, 96%, 97%, 98%, 99% or more of sequence identity with SEQ ID NO: 2.

In some embodiments of the process, the chiral amine product of formula (I) is:

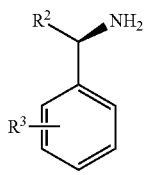

wherein $R^3$ is a $C_1$-$C_4$ hydrocarbyl, —H, halogen (such as —F, —Cl, —Br, and —I), —$NO_2$, —NO, —$SO_2R'$ or —SOR', —SR', —NR'R', —OR', —$CO_2R'$ or —COR', —C(O)NR', —$SO_2NH_2$ or —$SONH_2$, —CN, $CF_3$, wherein each R' is independently selected from —H or (C1-C4) hydrocarbyl;

$R^3$ may also

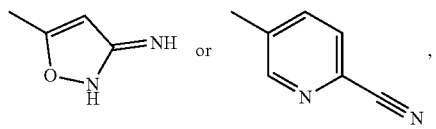

be $R^2$ is as defined above, and the ketone substrate of formula (II) is:

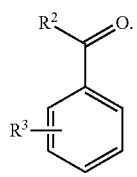

In some embodiments of this process, the chiral amine product of formula (I) is:

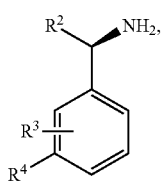

wherein $R^4$ is $R^3$ as defined above, $R^3$ and $R^2$ are as defined above, and the ketone substrate of formula (II) is:

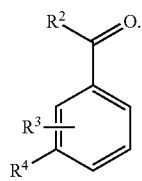

In some embodiments of the process, the chiral amine product of formula (I) is:

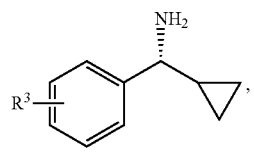

wherein $R^3$ is as defined above, and the ketone substrate of formula (II) is:

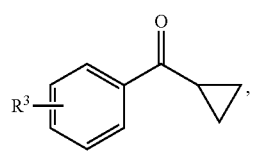

In some embodiments of the process, the chiral amine product of formula (I) is:

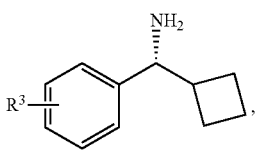

wherein $R^3$ is as defined above, and the ketone substrate of formula (II) is:

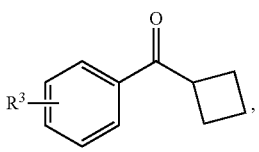

In some embodiments of the process, the chiral amine product of formula (I) is:

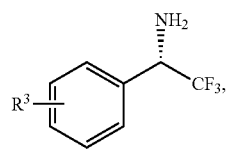

wherein $R^3$ is as defined above, and the ketone substrate of formula (II) is:

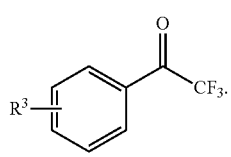

In some embodiments of the process, the chiral amine product of formula (I) is:

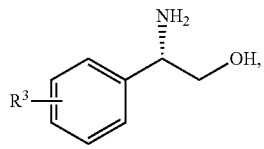

wherein R³ is as defined above, and the ketone substrate of formula (II) is:

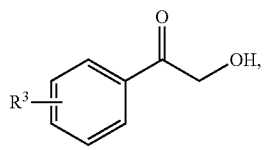

In some embodiments of the process, the chiral amine product of formula (I) is:

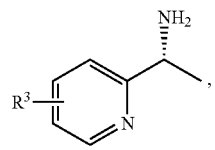

wherein R³ is as defined above, and the ketone substrate of formula (II) is:

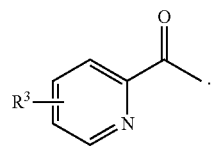

In some embodiments of the process, the chiral amine product of formula (I) is:

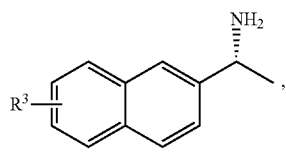

wherein R³ is as defined above, and the ketone substrate of formula (II) is:

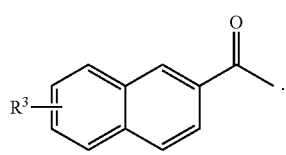

In some embodiments of the process, the chiral amine product of formula (I) is:

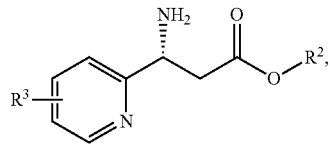

wherein R² and R³ are as defined above, and the ketone substrate of structural formula

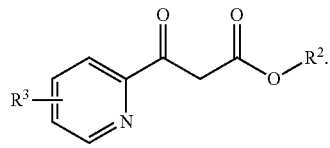

In some embodiments of the process, the chiral amine product of formula (I) is:

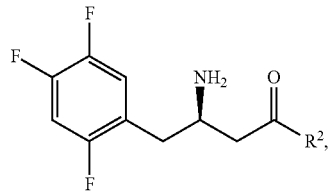

wherein R² is as defined above, and the ketone substrate of formula (II) is:

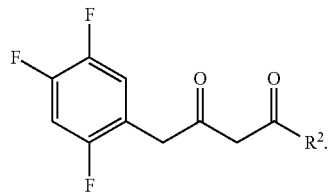

In some embodiments of the process, the chiral amine product of formula (I) is:

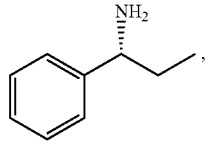

and the ketone substrate of structural formula (II) is:

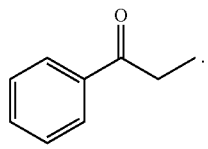

In some embodiments of the process, the chiral amine product of formula (I) is:

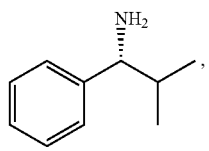

and the ketone substrate of structural formula (II) is:

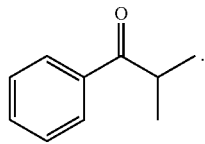

In some embodiments of the process, the chiral amine product of formula (I) is:

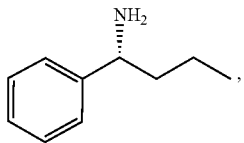

and the ketone substrate of structural formula (II) is:

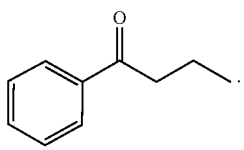

In some embodiments of the process, the chiral amine product of formula (I) is:

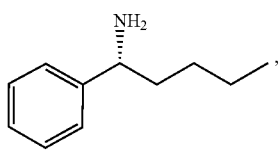

and the ketone substrate of structural formula (II) is:

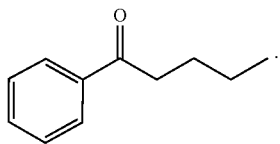

In some embodiments of the process, the chiral amine product of formula (I) is:

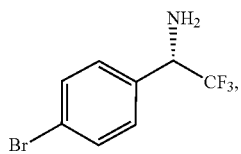 [SMILES: N[C@@H](c1ccc(Br)cc1)C(F)(F)F]

and the ketone substrate of structural formula (II) is:

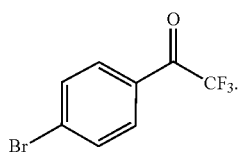 [SMILES: O=C(c1ccc(Br)cc1)C(F)(F)F]

In some embodiments of the process, the chiral amine product of formula (I) is:

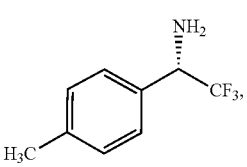

and the ketone substrate of structural formula (II) is:

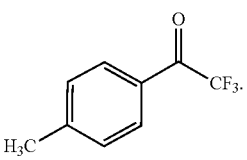

In some embodiments of the process, the chiral amine product of formula (I) is:

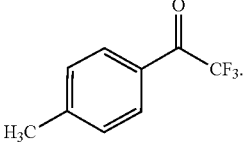

and the ketone substrate of structural formula (II) is:

In some embodiments of the process, the chiral amine product of formula (I) is:

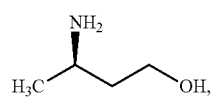

and the ketone substrate of structural formula (II) is:

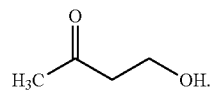

In some embodiments of the process, the chiral amine product of formula (I) is:

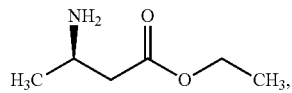

and the ketone substrate of structural formula (II) is:

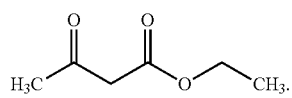

In some embodiments of the process, the chiral amine product of formula (I) is:

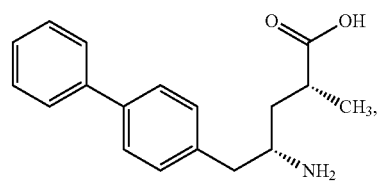

and the ketone substrate of structural formula (II) is:

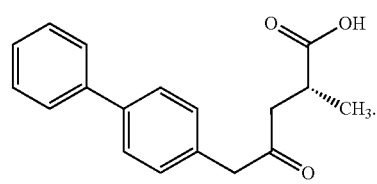 [SMILES: C[C@H](CC(=O)Cc1ccc(-c2ccccc2)cc1)C(=O)O]

In some embodiments of the process, the chiral amine product of formula (I) is:

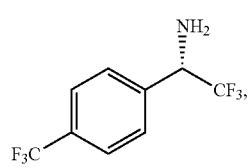

and the ketone substrate of structural formula (II) is:

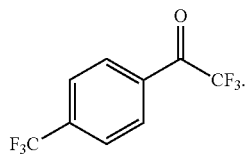

In some embodiments of the process, the chiral amine product of formula (I) is:

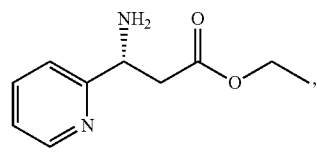

and the ketone substrate of structural formula (II) is:

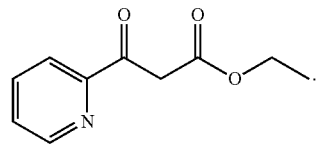

In some embodiments of the process, the chiral amine product of formula (I) is:

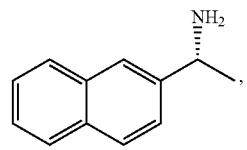

and the ketone substrate of structural formula (II) is:

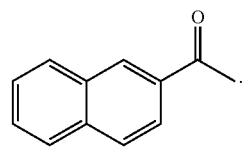

In some embodiments of the process, the chiral amine product of formula (I) is:

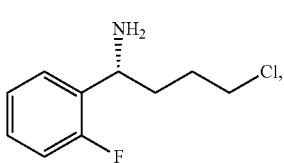 [SMILES: N[C@H](CCCCl)c1ccccc1F]

and the ketone substrate of structural formula (II) is:

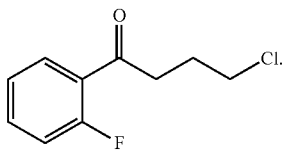 [SMILES: O=C(CCCCl)c1ccccc1F]

In some embodiments of the process, the chiral amine product of formula (I) is:

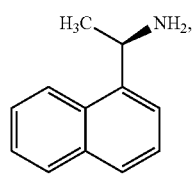

and the ketone substrate of structural formula (II) is:

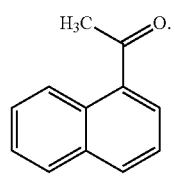

In some embodiments of the process, the chiral amine product of formula (I) is:

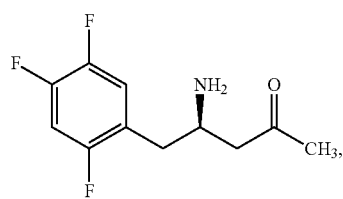 [SMILES: CC(=O)C[C@H](N)Cc1cc(F)c(F)cc1F]

and the ketone substrate of structural formula (II) is:

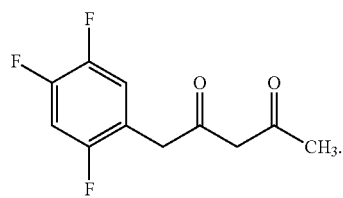

In some embodiments of the process, the chiral amine product of formula (I) is:

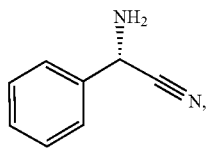

and the ketone substrate of structural formula (II) is:

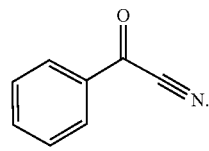

In some embodiments of the process, the chiral amine product of formula (I) is:

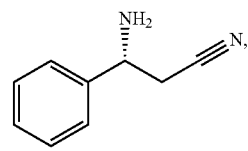 [SMILES: N#CC[C@@H](N)c1ccccc1]

and the ketone substrate of structural formula (II) is:

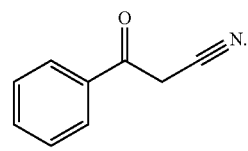 [SMILES: N#CCC(=O)c1ccccc1]

In some embodiments of the process, the chiral amine product of formula (I) is:

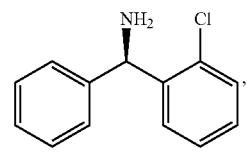 [SMILES: N[C@H](c1ccccc1)c1ccccc1Cl]

and the ketone substrate of structural formula (II) is:

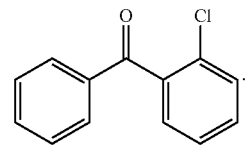 [SMILES: O=C(c1ccccc1)c1ccccc1Cl]

In some embodiments of the process, the chiral amine product of formula (I) is:

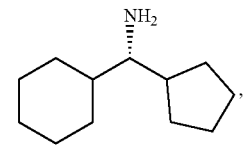 [SMILES: N[C@@H](C1CCCCC1)C1CCCC1]

and the ketone substrate of structural formula (II) is:

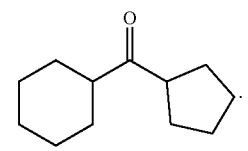 [SMILES: O=C(C1CCCCC1)C1CCCC1]

In some embodiments of the process, the chiral amine product of formula (I) is:

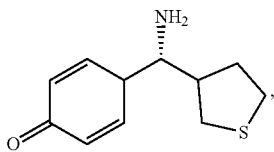 [SMILES: N[C@@H](C1C=CC(=O)C=C1)C1CCSC1]

and the ketone substrate of structural formula (II) is:

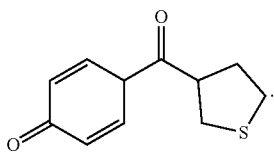 [SMILES: O=C1C=CC(C(=O)C2CCSC2)C=C1]

In some embodiments of the process, the chiral amine product of formula (I) is:

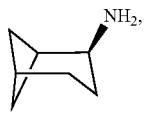

and the ketone substrate of structural formula (II) is

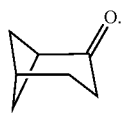

In some embodiments of the process, the chiral amine product of formula (I) is:

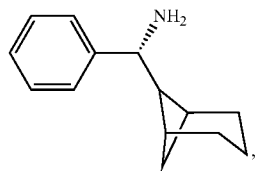 [SMILES: N[C@@H](c1ccccc1)C1C2CCCC1C2]

and the ketone substrate of structural formula (II) is

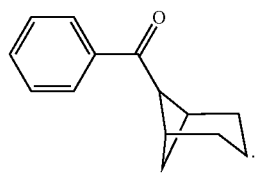 [SMILES: O=C(c1ccccc1)C1C2CCCC1C2]

In some embodiments of the process, the chiral amine product of formula (I) is:

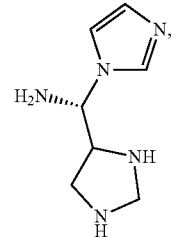

and the ketone substrate of structural formula (II) is

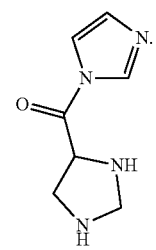 [SMILES: O=C(C1CNCN1)n1ccnc1]

In some embodiments of the process, the chiral amine product of formula (I) is:

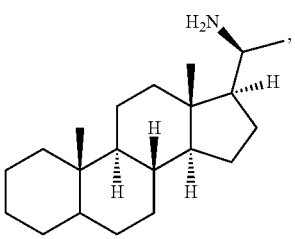

and the ketone substrate of structural formula (II) is:

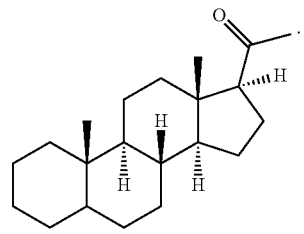

In some embodiments of the process, the chiral amine product of formula (I) is:

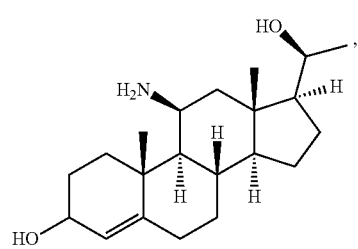

and the ketone substrate of structural formula (II) is:

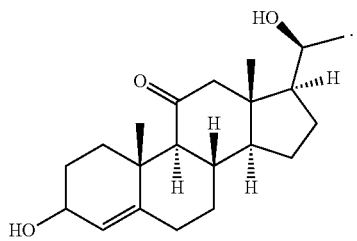

In some embodiments, the amine product of formula (I) produced in the above process is present in an enantiomeric excess of at least 70%, 75%, 80%, 85%, 90%, 91%, 92%, 93%, 94%, 95% 96%, 97%, 98% or 99% or more.

In some embodiments, an engineered transaminase polypeptide can be used in a process of preparing an enantiomeric excess of the compound of formula A2 R-PEA:

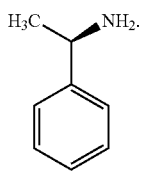

A2

In these embodiments, the process comprises that, under suitable reaction conditions, in the presence of an amine donor, the compound of formula A1

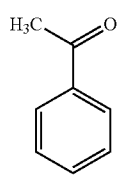

A1 were contacted with the engineered transaminase polypeptide disclosed herein.

In some embodiments of the above process, the compound of Formula (I) or the compound of Formula A2 is produced in an enantiomeric excess of at least 70%, 75%, 80%, 85%, 90%, 91%, 92%, 93%, 94%, 95%, 96%, 97%, 98%, 99% or more.

Specific embodiments of engineered transaminase polypeptides for use in the above process are further provided in the detailed description. Engineered transaminase polypeptides that can be used in the above process comprise amino acid sequences selected from SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400.

As described herein and exemplified in the examples, the present disclosure contemplates a range of suitable reaction conditions that may be used in the process herein, including but not limited to pH, temperature, buffer, solvent system, substrate loading, polypeptide loading, and reaction time. Additional suitable reaction conditions for performing a method of biocatalytically converting substrate compounds to product compounds using engineered transaminase polypeptides described herein can be readily optimized by routine experimentation, which includes but not limited to that the engineered transaminase polypeptide is contacted with substrate compounds under experimental reaction conditions of varying concentration of reaction substances, pH, temperature, solvent conditions, and the product compound is detected, for example, using the methods described in the Examples provided herein.

As described above, engineered polypeptides having transaminase activity for use in the process of the present disclosure generally comprise amino acid sequences that have at least 80%, 85%, 86%, 87%, 88%, 89%, 90%, 91%, 92%, 93%, 94%, 95%, 96%, 97%, 98% or 99% sequence identity to the reference amino acid sequence selected from any one of the even numbered sequences of SEQ ID NOs: 4-400.

The loading of substrate compounds in the reaction mixture can be varied, taking into consideration of, for example, the amount of the desired product compound, the effect of the substrate concentration on the enzyme activity, the stability of the enzyme under the reaction conditions, and the percent conversion of substrate to product. In some embodiments of the process, the suitable reaction conditions include at least 0.5 g/L, at least about 1 g/L, at least about 5 g/L, at least about 10 g/L, at least about 15 g/L, at least about 20 g/L, at least about 100 g/L, at least about 150 g/L, at least about 200 g/L, at least about 250 g/L, at least about 300 g/L, at least about 350 g/L, at least about 400 g/L or even more of loading of substrate (II) or substrate A1. The values for the substrate loading provided herein are based on the molecular weight of compound (II) or A1, however it is also contemplated that the equivalent molar amounts of various hydrates and salts of compound (II) or A1 may also be used in the process.

In the process described herein, the engineered transaminase polypeptides catalyze the formation of a chiral amine product from a ketone substrate and an amine donor. In some embodiments, the amine donor in the reaction conditions include amino acid compounds selected from alanine, isopropylamine (also known as 2-aminopropane), phenylalanine, glutamine, leucine or 3-aminobutyric acid; or chiral or achiral amine such as methylbenzylamine; the amine donor may also be in the form of a salt (e.g., alanine hydrochloride, alanine acetate, isopropylamine hydrochloride, isopropylamine acetate, etc) used in the embodiments. In some embodiments, the amine donor is isopropylamine. In some embodiments, suitable reaction conditions include an amine donor, particularly isopropylamine, present in a loading of at least 1 molar equivalent of the ketone substrate loading. In some embodiments, the isopropylamine is present at a loading of about 0.1 M to about 4.0 M or higher.

As shown in Scheme 1 or Scheme 2, the transaminase-catalyzed reaction is reversible, in some embodiments, the disclosed engineered transaminase polypeptides can also convert a chiral amine compound of formula (I) or formula A2 to a compound of formula (II) or formula A1, respectively.

In some embodiments of the reaction, the reaction conditions may include a suitable pH. As noted above, the desired pH or desired pH range can be maintained by using an acid or base, a suitable buffer, or a combination of buffer and added acid or base. The pH of the reaction mixture can be controlled before and/or during the reaction. In some embodiments, suitable reaction conditions include a solution pH of about 7 to about 11. In some embodiments, the reaction conditions include a solution pH of about 7, 7.5, 8, 8.5, 9, 9.5, 10, 10.5, or 11.

In embodiments of the processes herein, suitable temperatures can be used for the reaction conditions, taking into consideration of, for example, the increase in reaction rate at higher temperatures, and the activity of the enzyme for sufficient duration of reaction. Accordingly, in some embodiments, suitable reaction conditions include a temperature of about 10° C. to about 60° C., about 25° C. to about 50° C., about 25° C. to about 40° C., or about 25° C. to about 30° C. In some embodiments, suitable reaction temperatures include temperature of about 25° C., 30° C., 35° C., 40° C., 45° C., 50° C., 55° C., or 60° C. In some embodiments, the temperature during the enzymatic reaction can be maintained at a certain temperature throughout the reaction. In some embodiments, the temperature during the enzymatic reaction may be adjusted over a temperature profile during the course of the reaction.

The processes of using the engineered transaminases are generally carried out in a solvent. Suitable solvents include water, aqueous buffer solutions, organic solvents, and/or co-solvent systems, which generally include aqueous solvents and organic solvents. The aqueous solutions (water or aqueous co-solvent systems) can be pH-buffered or unbuffered. In some embodiments, the processes of using an engineered transaminase polypeptide are generally carried out in an aqueous co-solvent system comprising an organic solvent (e.g., methanol, ethanol, propanol, isopropanol, dimethyl sulfoxide (DMSO), dimethylformamide (DMF), isopropyl acetate, ethyl acetate, butyl acetate, 1-octanol, heptane, octane, methyl tert-butyl ether (MTBE), Toluene, etc.), ionic liquids (for example, 1-ethyl 4-methylimidazolium tetrafluoroborate, 1-butyl-3-methylimidazolium tetrafluoroborate, 1-butyl-3-methylimidazolium hexafluorophosphate, and the like). The organic solvent component of the aqueous co-solvent system may be miscible with the aqueous component, providing a single liquid phase, or may be partially miscible or immiscible with the aqueous component, providing two liquid phases. Exemplary aqueous co-solvent system comprises water and one or more organic solvents. In general, the organic solvent component of the aqueous co-solvent system is selected such that it does not completely inactivate the transaminase. Suitable co-solvent system can be readily identified by measuring the enzymatic activity of a particular engineered transaminase with a defined substrate of interest in the candidate solvent system, utilizing enzymatic activity assays, such as those described herein. In some embodiments of the process, suitable reaction conditions include an aqueous co-solvent comprising DMSO at a concentration of about 1% to almost 100% (v/v), about 1% to about 60% (v/v), about 2% to about 60% (v/v), about 5% to about 60% (v/v), about 10% to about 60% (v/v), about 10% to about 50% (v/v), or about 10% to about 40% (v/v) of total reaction volume. In some embodiments of the process, suitable reaction conditions include an aqueous co-solvent comprising DMSO at a concentration of at least about 1%, 5%, 10%, 15%, 20%, 25%, 30%, 35%, 40%, 45%, 50%, 55% or 60% (v/v).

Suitable reaction conditions can include a combination of reaction parameters that allows the biocatalytic conversion of the substrate compound to its corresponding product compound. Accordingly, in some embodiments of the process, the combination of reaction parameters comprises: (a) substrate loading of about 10 g/L to about 200 g/L; (b) Engineered polypeptide concentration of about 1 g/L to about 50 g/L; (c) pH of about 7.0 to 11.0; and (d) temperature of about 10° C. to 60° C. In some embodiments, the above process comprises that, in the presence of about 1M to about 2M of isopropylamine, with about 10% to about 40% DMSO, at a temperature of about 30° C. to about 50° C., at a pH of from 7.0 to 10.0, a ketone substrate at $\geqslant$ 10 g/L loading is contacted with the engineered transaminase polypeptide at $\geqslant$ 5 g/L described herein, while at least 70%, 80%, 90% or more of the ketone substrate is converted to a chiral amine product, and the chiral amine product is produced in an enantiomeric excess of at least 60%, 65%, 70%, 75%, 80%, 85%, 90%, 91%, 92%, 93%, 94%, 95%, 96% 97%, 98%, 99% or more. In some embodiments, the transaminase polypeptides capable of performing a commercial reaction comprise the amino acid sequence selected from SEQ ID NO:4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400.

Exemplary reaction conditions include the conditions provided in Table 2 and Example 7.

In carrying out the reaction described herein, the engineered transaminase polypeptide may be added to the reaction mixture in the partially purified or purified forms, whole cells transformed with the gene encoding the engineered transaminase polypeptide, and/or as cell extracts and/or lysates of such cells. Whole cells transformed with the gene encoding the engineered transaminase or cell extracts, lysates thereof, and isolated enzymes can be used in a wide variety of different forms, including solids (e.g., lyophilized, spray dried, or the like) or semisolid (e.g., a crude paste of wet cells). The cell extract or cell lysate may be partially purified by precipitation (e.g., ammonium sulfate, polyethyleneimine, heat treatment or the like), followed by desalting procedures (e.g., ultrafiltration, dialysis, and the like) prior to lyophilization. Any of the enzyme preparations can be stabilized by crosslinking using known crosslinking agents, such as glutaraldehyde, or immobilization to a solid phase material (such as a resin).

In some embodiments of the reaction described herein, the reaction is performed under suitable reaction conditions described herein, wherein the engineered transaminase polypeptide is immobilized on a solid support. Solid supports useful for immobilizing the engineered transaminase enzyme for carrying out the reaction include but are not limited to beads or resins such as polymethacrylates with epoxy functional groups, polymethacrylates with amino epoxy functional groups, polymethacrylates, styrene/DVB copolymer or polymethacrylates with octadecyl functional groups. Exemplary solid supports include, but are not limited to, chitosan beads, Eupergit C, and SEPABEADs (Mitsubishi), including the following different types of SEPABEAD: EC-EP, EC-HFA/S, EXA252, EXE119 and EXE120.

In some embodiments, wherein the engineered polypeptide is expressed in the form of a secreted polypeptide, a culture medium containing the secreted polypeptide can be used in the process herein.

In some embodiments, the solid reactants (e.g., enzymes, salts, etc.) can be provided to the reaction in a variety of different forms, including powders (e.g., lyophilized, spray dried, etc.), solutions, emulsions, suspensions and the like. The reactants can be readily lyophilized or spray-dried using methods and instrumentation known to one skilled in the art. For example, the protein solution can be frozen at −80° C. in small aliquots, and then added to the pre-chilled lyophilization chamber, followed by the application of a vacuum.

In some embodiments, the order of addition of reactants is not critical. The reactants may be added together to the solvent at the same time (e.g., monophasic solvent, a biphasic aqueous co-solvent system, etc.), or alternatively, some reactants may be added separately, and some may be added at different time points. For example, transaminase and substrate may be added first to the solvent, and the organic solvent can then be added and mixed. Alternatively, the substrates can be premixed in the organic solvent prior to addition to the aqueous phase.

Different features and embodiments of the present disclosure are exemplified in the following representative examples, which are intended to be illustrative and not restrictive.

EXAMPLES

The following examples further illustrate the present invention, but the present invention is not limited thereto. In the following examples, experimental methods with conditions not specified, were conducted at the commonly used conditions or according to the suppliers' suggestion.

Example 1: Gene Cloning and Construction of Expression Vectors

The amino acid sequence of the wild-type transaminase from *Aspergillus fumigatus* can be retrieved from NCBI, and the corresponding nucleic acids were then synthesized by a vendor using conventional techniques in the art and cloned into the expression vector pACYC-Duet-1. The recombinant expression plasmid was transformed into *E. coli* BL21 (DE3) competent cells under the conditions of 42° C. and thermal shock for 90 seconds. The transformation was plated on LB agar plates containing chloramphenicol which was then incubated overnight at 37° C. Recombinant transformants were obtained.

Example 2: Expression of Transaminase Polypeptides Using Shaking Flasks

The recombinant *E. coli* BL21 (DE3) transformant obtained in Example 1 was inoculated into 50 mL LB medium containing chloramphenicol (peptone 10 g/L, yeast extract powder 5 g/L, sodium chloride 10 g/L, pH 7.0±0.2, 25° C.) in a 250 mL Erlenmeyer flask, which was then cultured in a shaking incubator at 30° C., 250 rpm overnight. When the $OD_{600}$ of this overnight culture reached 2, it was subcultured at the inoculum of 5% (v/v) into a 1.0 L flask containing 250 mL of TB medium (tryptone 12 g/L, yeast extract 24 g/L, disodium hydrogen phosphate 9.4 g/L, dipotassium hydrogen phosphate 2.2 g/L, pH 7.2±0.2, 30° C.). Lactose was added into the TB medium at a final concentration of 6 g/L to induce the expression, and this expression culture was placed in a shaking incubator at 30° C., 250 rpm overnight. After about 20 h, the expression culture was centrifuged; the wet cells were collected after centrifugation, washed twice with PBS buffer (pH 7.4), and then can be stored at −20° C. until use. To disrupt the cell, the obtained wet cells were resuspended with 50 mL of PBS buffer (pH 7.4), and the suspension was placed in an ice bath and sonicated for 5 min. The resulting cell lysate was clarified by centrifugation at 8000 rpm for 10 min at 4° C. using a Thermo Multifuge X3R centrifuge. The clarified cell lysate was frozen at −20° C. and lyophilized into an enzyme powder. The resulting transaminase enzyme powder can be stored at −20° C. until use.

Example 3: Construction of a Transaminase Mutant Library

Quikchange kit (supplier: Agilent) was used here. The sequence design of the mutagenesis primers was performed according to the instructions of the kit. The construction of a site-saturation mutagenesis library is as following. The PCR reaction consisted of 10 μl of 5× Buffer, 1 μl of 10 mM dNTP, 1 μl of plasmid DNA template (50 ng/μl), 0.75 μl (10 uM) each of the upstream and downstream primers, 0.5 μl of high fidelity enzyme and 36 μl of ddH2O, The PCR primer has a NNK codon at the mutation position.

PCR amplification steps: (1) 98° C. pre-denaturation 3 min; (2) 98° C. denaturation 10 s; (3) annealing and extension 3 min at 72° C.; steps of (2)~(3) repeated 25 times; (5) extension 10 min at 72° C.; (6) cooling to 4° C., 2 μl of DpnI was added to the PCR product and the plasmid template was eliminated by overnight digestion at 37° C. The digested PCR product was transformed into *E. coli* BL21 (DE3) competent cells and plated on LB agar plates containing chloramphenicol to obtain a site-saturation mutagenesis library.

Example 4: High-Throughput Screening of Transaminase Mutant Libraries

The expression of transaminase mutant library was done in 96-well plate by miniaturizing the expression condition in shaking flasks (proportionally reducing the culture scale from flask to 96-well plate), and the specific operation procedure was as follows. A single clone of the enzyme mutant library was picked from the LB agar plate, inoculated into 200 μL/well LB medium (containing chloramphenicol) in a 96-well shallow plate, and cultured overnight for 18 to 20 hours at 30° C., in a shaker at 180 rpm, and 80% humidity. When $OD_{600}$ of shallow plate culture was about 2.0, 20 μl of this culture was taken to inoculate a fresh 400 μL/well TB medium (containing chloramphenicol) in a 96-well deep well plate and cultured in a shaker at 250 rpm, 30° C., and 80% humidity. When $OD_{600}$ of deep-well culture reached 0.6~0.8, IPTG was added at a final concentration of 1 mM to induce expression, and the expression undertook at 30° C. overnight for 18 to 20 hours. Finally, the expression culture was centrifuged at 4000 rpm for 10 minutes to collect wet cells in 96-well plates which can be stored at −20° C. until use.

The screening assay for the enzyme mutant library was based on the transaminase reaction of converting acetophenone to R-PEA, and it is given as follows:

To the 96-well plate containing the wet cells as obtained above, 200 μL/well of cell lysis buffer was added, and the plate was sealed, placed on a plate shaker at 700 rpm for 1 h to disrupt the cell, and then centrifuged at 4000 rpm for 10 min. The supernatant of cell lysate was collected. Stock solution of reaction buffer [0.4 mM PLP, 6M IPM, 0.1M TEOA, pH9.0 (25° C.)] was prepared, and it was transferred into a fresh assay plate (96 deep well plate) with 50 μL/well using a liquid handler; stock solution of acetophenone in methanol was prepared, and it was transferred into the assay plate with 50 μL/well; finally the supernatant of cell lysate obtained above was transferred to the assay plate with 100 μL/well, so the total reaction volume was about 200 μL/well, and the final reaction setup is about [0.1 mM PLP, 1.5M IPM, 50 g/L acetophenone, 25% v/v methonal]. The assay plate was heat-sealed with an aluminum film, placed in a shaker and reacted at 30° C., 200 rpm for 20 h. After reaction, 400 μl of ACN (acetonitrile) was added to each well of the assay plate to quench the reaction (shaking at 800 rpm for 1 h). After quenching, samples were taken from the reaction for HPLC analysis to measure the conversion in each well.

Example 5: HPLC Analysis Method

High-throughput analysis method using HPLC is as follows: analytical column is LP-C18 150*4.6 mm, mobile phase is 0.4% aqueous perchloric acid (pH 1.5): acetonitrile=55:45, flow rate is 2.2 mL/Min, the column temperature is 40° C., the detection wavelength is 220 nm, the analysis time is 2.5 min, the retention time of acetophenone is 2.34 min, and the retention time of R-PEA is 0.97 min.

Chiral analysis of α-phenylethylamine: analytical column is CROWNPAK CR-I (+) 150*4.6 mm, mobile phase is 0.8% aqueous perchloric acid (pH 1): acetonitrile=70:30, flow rate is 0.5 mL/min. The column temperature is 30° C. The detection wavelength is 210 nm, the analysis time is 10 min, the retention time of acetophenone is 4.53 min, the retention time of R-(+)-α-phenylethylamine is 5.82 min, and the retention time of S-(−)-α-phenylethylamine is 8.62 min.

Example 6: Fermentation Process for Expression of Engineered Transaminase and Enzyme Powder Preparation A single colony of *E. coli* BL21 (DE3) containing a plasmid bearing the gene of target engineered transaminase was inoculated into 50 mL LB broth containing 30 μg/mL chloramphenicol (5.0 g/L Yeast Extract LP0021, 10 g/L Tryptone LP0042, 10 g/L of sodium chloride). Cells were incubated at least 16 hours with shaking at 250 rpm in a 30° C. shaker. When the OD$_{600}$ of the culture reached 3.5 to 4.5, the culture was used to inoculate a fermentor.

A 1.0 L fermentor containing 0.4 L of growth medium was sterilized at 121° C. for 30 min. The fermentor was inoculated with the abovementioned culture. Temperature of fermentor was maintained at 37° C. The medium in fermentor was agitated at 200-800 rpm and air was supplied to the fermentation vessel at 0.4-0.8 L/min to maintain the dissolved oxygen level at 30% saturation or greater. The culture was maintained at pH 7.0 by addition of 25-28% v/v ammonium hydroxide. Cell growth was maintained by feeding a feed solution containing 500 g/L of dextrose monohydrate, 12 g/L of ammonium chloride, and 5 g/L of magnesium sulfate heptahydrate. After the OD$_{600}$ of culture reached 25±5° C., the temperature of fermentor was decreased and maintained at 30° C., and the expression of transaminase was induced by the addition of isopropyl-β-D-thiogalactoside (IPTG) to a final concentration of 0.3 mM. Fermentation process then continued for additional 16 hours. After the fermentation process was complete, cells were harvested using a Thermo Multifuge X3R centrifuge at 8000 rpm for 10 min at 4° C. Harvested cells were used directly in the downstream recovery process or stored frozen at −20° C.

6 g of the wet cells were resuspended in 30 mL of 100 mM potassium phosphate buffer containing 250 uM pyridoxal 5'-phosphate (PLP), pH 7.5 at 4° C. The transaminase was released from the cells by disruption twice using a homogenizer at 800 bar. The resulting cell lysate was clarified by centrifugation at 8000 rpm for 10 min at 4° C. using a Thermo Multifuge X3R centrifuge. The clarified supernatant was lyophilized into enzyme powder. The transaminase enzyme powder was stored frozen at −20° C.

Example 7 Reaction Process for Asymmetric Synthesis of R-PEA by Engineered Transaminase Polypeptide The following is a representative reaction process at 50 mL reaction volume. Stock solution of isopropylamine: 8 mL of triethanolamine buffer (0.1 M, pH 9) was mixed with 6.9 mL of isopropylamine, then hydrochloric acid was added to adjust the pH to 9, and it was topped up to 20 mL with triethanolamine buffer (0.1 M, pH 9). To a 250 mL reaction vessel, 0.25 g of enzyme powder (SEQ ID No: 390), 17.07 mL of triethanolamine buffer (pH 9), 20 mL of the above stock solution of isopropylamine, 500 uL of 10 mM pyridoxal phosphate solution, 10 mL of methanol, were added and stirred. After mixing, 2.43 mL of acetophenone was added to the reaction vessel. The temperature of reaction was maintained at 30° C. with a water bath, the stirring speed was 200 rpm, and a negative pressure was applied to the reaction vessel to remove the produced acetone. After 24 hours, the conversion of acetophenone to R-PEA was 80%, and the ee value of the product R-PEA was 99%.

Example 8 Reaction Process for the Synthesis of (R)-(+)-α-(1-Naphthyl)Ethylamine Catalyzed by Engineered Transaminase Polypeptide

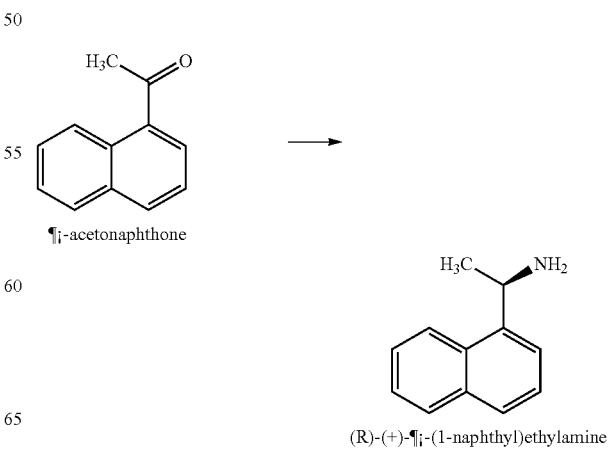

Stock solution of isopropylamine: 8 mL of triethanolamine buffer (0.1 M, pH 8) was mixed with 6.9 mL of isopropylamine, then hydrochloric acid was added to adjust the pH to 8, and it was topped up to 20 mL with triethanolamine buffer (0.1 M, pH 8). To a 250 mL reaction vessel, 150 mg of enzyme powder (SEQ ID No: 352), 38 mL of triethanolamine buffer (pH 8), 6.5 mL of the above stock solution of isopropylamine, 500 uL of 10 mM pyridoxal phosphate solution, were added and stirred. After mixing, a solution of α-acetonaphthone dissolved in DMSO was added to the reaction vessel to a final concentration of 10% DMSO and 20 g/L substrate α-acetonaphthone. The temperature of reaction was maintained at 30° C. with a water bath, stirring speed is 400 rpm, and a negative pressure was applied to the reaction vessel to remove the produced acetone. After 24 hours, the conversion of α-acetonaphthone to (R)-(+)-α-(1-Naphthyl)ethylamine was 70%, and the ee value of the product (R)-(+)-α-(1-naphthyl)ethylamine was 99.5%.

Example 9 Reaction Process for the Synthesis of (R)-3-Amino-4-(2,4,5-trifluorophenyl)butyric Acid Methyl Ester Catalyzed by Engineered Transaminase Polypeptide

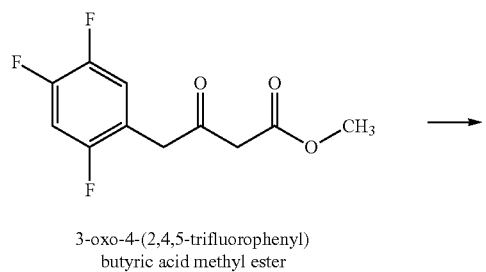

3-oxo-4-(2,4,5-trifluorophenyl) butyric acid methyl ester

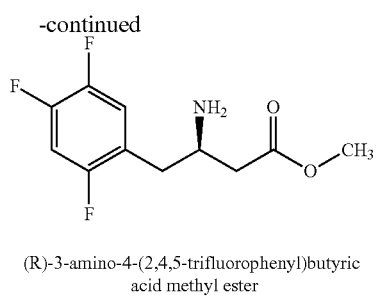

(R)-3-amino-4-(2,4,5-trifluorophenyl)butyric acid methyl ester

Stock solution of isopropylamine: 8 mL of triethanolamine buffer (0.1 M, pH 9.5) was mixed with 6.9 mL of isopropylamine, then hydrochloric acid was added to adjust the pH to 9.5, and it was topped up to 20 mL with triethanolamine buffer (0.1 M, pH 9.5). To a 250 mL reaction vessel, 250 mg of enzyme powder (SEQ ID No: 80), 38 mL of triethanolamine buffer (pH 9.5), 6.5 mL of the above stock solution of isopropylamine, 500 uL of 10 mM pyridoxal phosphate solution, were added and stirred. After mixing, a solution of 3-oxo-4-(2,4,5-trifluorophenyl)butyric acid methyl ester dissolved in DMSO was added to the reaction vessel to a final concentration of 10% DMSO, 2 g/L substrate 3-oxo-4-(2,4,5-trifluorophenyl)butyric acid methyl ester. The temperature of reaction was maintained at 30° C. with a water bath, and stirring speed is 400 rpm. After 24 hours, the conversion of 3-oxo-4-(2,4,5-trifluorophenyl)butyric acid methyl ester to (R)-3-amino-4-(2,4,5-trifluorophenyl)butyric acid methyl ester was 50%, and the ee value of the product (R)-3-amino-4-(2,4,5-trifluorophenyl)butyric acid methyl ester was 99%.

It should be understood that after reading the above contents of the present invention, those skilled in the art may make various modifications or changes to the present invention. And these equivalent forms also fall within the scope of the appended claims of the present invention.

SEQUENCE LISTING (400 sequences)

SEQ ID NO: 1 - DNA, 969 bp, Artificial sequence
  Engineered sequence
atggcctctatggacaaagtcttttcgggatattatgcgcgccagaagctgcttgaacggagcgacaatcctttctctaagggcattgcttatgtggaaggaaagctcgtcttacctagtgatgctagaataccgctactcgacgaaggtttcatgcacagtgacctaacctatgatgttatatcggtttgggatggtcgcttctttcgattggacgatcatttgcaacggattttggaaagctgcgataagatgcggctcaagttcccacttgcactgagctcagtgaaaaatattctggctgagatggtcgccaagagtggtatccgggatgcgtttgtggaagttattgtgacacgtggtctgacaggtgtacgtggttcgaagcctgaggatctgtataataacaacatatacctgcttgttcttccatacatttgggttatggcgcctgagaaccagctccatggtggcgaggctatcattacaaggacagtgcgacgaacacccccaggtgcatttgatcctactatcaaaaatctacagtggggtgatttaacaaagggactttttgaggcaatggaccgtggcgccacatacccatttctcactgatggagacaccaaccttactgaaggatctggtttcaacattgttttggtgaagaacggtattatctatacccctgatcgaggtgtcttgcgagggatcacacgtaaaagtgtgattgacgttgcccgagccaacagcatcgacatccgccttgaggtcgtaccagtggagcaggcttatcactctgatgagatcttcatgtgcacaactgccggcggcattatgcctataacattgcttgatggtcaacctgttaatgacggccaggttggcccaatcacaaagaagatatgggatggctattgggagatgcactacaatccggcgtatagttttcctgttgactatggcagtggc

SEQ ID NO: 2 - protein, 323 aa, Aspergillus fumigatus
MASMDKVFSGYYARQKLLERSDNPFSKGIAYVEGKLVLPSDARIPLLDEGFMHSDLTYDVISVWDGRFFRLDDHLQRILESCDKMRLKFPLALSSVKNILAEMVAKSGIRDAFVEVIVTRGLTGVRGSKPEDLYNNNIYLLVLPYIWVMAPENQLHGGEAIITRTVRRTPPGAFDPTIKNLQWGDLTKGLFEAMDRGATYPFLTDGDTNLTEGSGFNIVLVKNGIIYTPDRGVLRGITRKSVIDVARANSIDIRLEVVPVEQAYHSDEIFMCTTAGGIMPITLLDGQPVNDGQVGPITKKIWDGYWEMHYNPAYSFPVDYGSG

SEQ ID NO: 3 - DNA, 969 bp, Artificial sequence
  Engineered sequence
atggcttcgatggacaaagtcttctcaggttactacgcccgtcaaaaactgctggaacgctcagataatccgttctcaaaaggtattgcctatgtcgaaggtaaactggtgctgccgagtgatgcgcgcattccgctgctggacgaaggctttatgcatagtgatctgacctacgacgttatctccgtctgggacggccgtttctttcgcctggatgaccacctgcagcgcattctggaatcatgcgataaaatgcgtctgaaatttccgctggcactgagctctgtcaaaaatatcctggcagaaatggtggctaaaagcggcattcgtgacgctttcgtcgaagtgatcgttacccgcggcctgacgggtgttcgtggctctaaaccggaagatctgtataacaataacatttacctgctggtgctgccgtatatctggctgatggcaccggaaaatcagctgcatggcggtgaagctattatcacccgtacggtgcgtcgcaccccgccgggtgcctttgatccgacgatcaaaaacctgcaatggggtgacctgattaaaggcatgtttgaagcgatggatcgtggtgccacctatccgttcctgacggatggcgacaccaatctgacggaaggctgcggtttcaatattgtcctggtgaaaaacggtattatctacaccccggatcgtggtgttctgcgcggcattacgcgtaaatcagtgatcgatgttgcgcgcgccaactcgattgacatccgtctggaagtggttccggtggaacaagcgtaccactccgatgaaattttcatgtgtaccacggccggcggtattatgccgatcaccctgctggatggtcagccggttaacgacggtcaagtcggcccgattaccaagaaaatttgggatggctattgggaaatgcactacaacccggcttattcgtttccggtggattatggcagcggt

SEQ ID NO: 4 - protein, 323 aa, Artificial sequence
  Engineered sequence
MASMDKVFSGYYARQKLLERSDNPFSKGIAYVEGKLVLPSDARIPLLDEGFMHSDLTYDVISVWDGRFFRLDDHLQRILESCDKMRLKFPLALSSVKNILAEMVAKSGIRDAFVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGCGFNIVLVKNGIIYTPDRGVLRGITRKSVIDVARANSIDIRLEVVPVEQAYHSDEIFMCTTAGGIMPITLLDGQPVNDGQVGPITKKIWDGYWEMHYNPAYSFPVDYGSG

SEQ ID NO: 5 - DNA, 969 bp, Artificial sequence
  Engineered sequence
atggcctctatggacaaagtcttttcgggatattatgcgcgccagaagctgcttgaacggagcgacaatcctttctctaagggcattgcttatgtggaaggaaagctcgtcttacctagtgatgctagaataccgctactcgacgaaggtttcatgcacagtgacgcgacctatgatgttatatcggtttgggatggtcgcttctttcgattggacgatcatttgcaacggattttggaaagctgcgataagatgcggctcaagttcccacttgcactgagctcagtgaaaaatattctggctgagatggtcgccaagagtggtatccgggatgcgtttgtggaagttattgtgacacgtggtctgacaggtgtacgtggttcgaagcctgaggatctgtataataacaacatatacctgcttgttcttccatacatttggctgatggcgcctgagaaccagctccatggtggcgaggctatcattacaaggacagtgcgacgaacacccccaggtgcatttgatcctactatcaaaaatctacagtggggtgatttaattaagggaatgtttgaggcaatggaccgtggcgccacatacccatttctcactgatggagacaccaaccttactgaaggatgcggtttcaacattgttttggtgaagaacggtattatctatacccctgatcgaggtgtcttgcgagggatcacacgtaaaagtgtgattgacgttgcccgagccaacagcatcgacatccgccttgaggtcgtaccagtggagcaggcttatcactctgatgagatcttcatgtgcacaactgccggcggcattatgcctataacattgcttgatggtcaacctgttaatgacggccaggttggcccaatcacaaagaagatatgggatggctattgggagatgcactacaatccggcgtatagttttcctgttgactatggcagtggc

SEQ ID NO: 6 - protein, 323 aa, Artificial sequence
  Engineered sequence
MASMDKVFSGYYARQKLLERSDNPFSKGIAYVEGKLVLPSDARIPLLDEGFMHSDATYDVISVWDGRFFRLDDHLQRILESCDKMRLKFPLALSSVKNILAEMVAKSGIRDAFVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGCGFNIVLVKNGIIYTPDRGVLRGITRKSVIDVARANSIDIRLEVVPVEQAYHSDEIFMCTTAGGIMPITLLDGQPVNDGQVGPITKKIWDGYWEMHYNPAYSFPVDYGSG

SEQ ID NO: 7 - DNA, 969 bp, Artificial sequence
  Engineered sequence
atggcctctatggacaaagtcttttcgggatattatgcgcgccagaagctgcttgaacggagcgacaatcctttctctaagggcattgcttatgtggaaggaaagctcgtcttacctagtgatgctagaataccgctactcgacgaaggtttcatgcacagtgacctaacctatgatgttatatcggtttgggatggtcgcttctttcgattggacgatcatttgcaacggattttggaaagctgcgataagatgcggctcaagttcccacttgcactgagctcagtgaaaaatattctggctgagatggtcgccaagagtggtatccgggatgcgtttgtggaagttattgtgacacgtggtctgacaggtgtacgtggttcgaagcctgaggatctgtataataacaacatatacctgcttgttcttccatacatttggctgatggcgcctgagaaccagctccatggtggcgaggctatcattacaaggacagtgcgacgaacacccccaggtgcatttgatcctactatcaaaaatctacagtggggtgatttaattaagggaatgtttgaggcaatggaccgtggcgccacatacccatttctcactgatggagacaccaaccttactgaaggacctggtttcaacattgttttggtgaagaacggtattatctatacccctgatcgaggtgtcttgcgagggatcacacgtaaaagtgtgattgacgttgcccgagccaacagcatcgacatccgccttgaggtcgtaccagtggagcaggcttatcactctgatgagatcttcatgtgcacaactgccggcggcattatgcctataacattgcttgatggtcaacctgttaatgacggccaggttggcccaatcacaaagaagatatgggatggctattgggagatgcactacaatccggcgtatagttttcctgttgactatggcagtggc

SEQ ID NO: 8 - protein, 323 aa, Artificial sequence
  Engineered sequence
MASMDKVFSGYYARQKLLERSDNPFSKGIAYVEGKLVLPSDARIPLLDEGFMHSDLTYDVISVWDGRFFRLDDHLQRILESCDKMRLKFPLALSSVKNILAEMVAKSGIRDAFVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGPGFNIVLVKNGIIYTPDRGVLRGITRKSVIDVARANSIDIRLEVVPVEQAYHSDEIFMCTTAGGIMPITLLDGQPVNDGQVGPITKKIWDGYWEMHYNPAYSFPVDYGSG

SEQ ID NO: 9 - DNA, 969 bp, Artificial sequence
  Engineered sequence
atggcctctatggacaaagtcttttcgggatattatgcgcgccagaagctgcttgaacggagcgacaatcctttctctaagggcattgcttatgtggaaggaaagctcgtcttacctagtgatgctagaataccgctactcgacgaaggtttcatgcacagtgacctaacctatgatgttatatcggtttgggatggtcgcttctttcgattggacgatcatttgcaacggattttggaaagctgcgataagatgcggctcaagttcccacttgcactgagctcagtgaaaaatattctggctgagatggtcgccaagagtggtatccgggatgcgtttgtggaagttattgtgacacgtggtctgacaggtgtacgtggttcgaagcctgaggatctgtataataacaacatatacctgcttgttcttccatacatttggctgatggcgcctgagaaccagctccatggtggcgaggctatcattacaaggacagtgcgacgaacacccccaggtgcatttgatcctactatcaaaaatctacagtggggtgatttaattaagggaatgtttgaggcaatggaccgtggcgccacatacccatttctcactgatggagacaccaaccttactgaaggaagtggtttcaacattgttttggtgaagaacggtattatctatacccctgatcgaggtgtcttgcgagggatcacacgtaaaagtgtgattgacgttgcccgagccaacagcatcgacatccgccttgaggtcgtaccagtggagcaggcttatcactctgatgagatcttcatgtgcacaactgccggcggcattatgcctataacattgcttgatggtcaacctgttaatgacggccaggttggcccaatcacaaagaagatatgggatggctattgggagatgcactacaatccggcgtatagttttcctgttgactatggcagtggc

SEQ ID NO: 10 - protein, 323 aa, Artificial sequence
  Engineered sequence
MASMDKVFSGYYARQKLLERSDNPFSKGIAYVEGKLVLPSDARIPLLDEGFMHSDLTYDVISVWDGRFFRLDDHLQRILESCDKMRLKFPLALSSVKNILAEMVAKSGIRDAFVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLRGITRKSVIDVARANSIDIRLEVVPVEQAYHSDEIFMCTTAGGIMPITLLDGQPVNDGQVGPITKKIWDGYWEMHYNPAYSFPVDYGSG

SEQ ID NO: 11 - DNA, 969 bp, Artificial sequence
  Engineered sequence
atggcctctatggacaaagtcttttcgggatattatgcgcgccagaagctgcttgaacggagcgacaatcctttctctaagggcattgcttatgtggaaggaaagctcgtcttacctagtgatgctagaataccgctactcgacgaaggtttcatgcacagtgacctaacctatgatgttatatcggtttgggatggtcgcttctttcgattggacgatcatttgcaacggattttggaaagctgcgataagatgcggctcaagttcccacttgcactgagctcagtgaaaaatattctggctgagatggtcgccaagagtggtatccgggatgcgtttgtggaagttattgtgacacgtggtctgacaggtgtacgtggttcgaagcctgaggatctgtataataacaacatatacctgcttgttcttccatacatttggctgatggcgcctgagaaccagctccatggtggcgaggctatcattacaaggacagtgcgacgaacacccccaggtgcatttgatcctactatcaaaaatctacagtggggtgatttaattaagggaatgtttgaggcaatggaccgtggcgccacatacccatttctcactgatggagacaccaaccttactgaaggatgcggtttcaacattgttttggtgaagaacggtattatctatacccctgatcgaggtgtcttggaggggatcacacgtaaaagtgtgattgacgttgcccgagccaacagcatcgacatccgccttgaggtcgtaccagtggagcaggcttatcactctgatgagatcttcatgtgcacaactgccggcggcattatgcctataacattgcttgatggtcaacctgttaatgacggccaggttggcccaatcacaaagaagatatgggatggctattgggagatgcactacaatccggcgtatagttttcctgttgactatggcagtggc

SEQ ID NO: 12 - protein, 323 aa, Artificial sequence
  Engineered sequence
MASMDKVFSGYYARQKLLERSDNPFSKGIAYVEGKLVLPSDARIPLLDEGFMHSDLTYDVISVWDGRFFRLDDHLQRILESCDKMRLKFPLALSSVKNILAEMVAKSGIRDAFVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGCGFNIVLVKNGIIYTPDRGVLEGITRKSVIDVARANSIDIRLEVVPVEQAYHSDEIFMCTTAGGIMPITLLDGQPVNDGQVGPITKKIWDGYWEMHYNPAYSFPVDYGSG

SEQ ID NO: 13 - DNA, 969 bp, Artificial sequence
  Engineered sequence
atggcctctatggacaaagtcttttcgggatattatgcgcgccagaagctgcttgaacggagcgacaatcctttctctaagggcattgcttatgtggaaggaaagctcgtcttacctagtgatgctagaataccgctactcgacgaaggtttcatgcacagtgacctaacctatgatgttatatcggtttgggatggtcgcttctttcgattggacgatcatttgcaacggattttggaaagctgcgataagatgcggctcaagttcccacttgcactgagctcagtgaaaaatattctggctgagatggtcgccaagagtggtatccgggatgcgtttgtggaagttattgtgacacgtggtctgacaggtgtacgtggttcgaagcctgaggatctgtataataacaacatatacctgcttgttcttccatacatttggctgatggcgcctgagaaccagctccatggtggcgaggctatcattacaaggacagtgcgacgaacacccccaggtgcatttgatcctactatcaaaaatctacagtggggtgatttaattaagggaatgtttgaggcaatggaccgtggcgccacatacccatttctcactgatggagacaccaaccttactgaaggatgcggtttcaacattgttttggtgaagaacggtattatctatacccctgatcgaggtgtcttgcgagggatcacacgtaaaagtgtgattgacgttgcccgagccaacagcatcgacatccgccttgaggtcgtaccagtggagcaggcttatcactctgatgagatcttcatgtgctcgactgccggcggcattatgcctataacattgcttgatggtcaacctgttaatgacggccaggttggcccaatcacaaagaagatatgggatggctattgggagatgcactacaatccggcgtatagttttcctgttgactatggcagtggc

SEQ ID NO: 14 - protein, 323 aa, Artificial sequence
  Engineered sequence
MASMDKVFSGYYARQKLLERSDNPFSKGIAYVEGKLVLPSDARIPLLDEGFMHSDLTYDVISVWDGRFFRLDDHLQRILESCDKMRLKFPLALSSVKNILAEMVAKSGIRDAFVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGCGFNIVLVKNGIIYTPDRGVLRGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 15 - DNA, 969 bp, Artificial sequence
  Engineered sequence
atggcctctatggacaaagtcttttcgggatattatgcgcgccagaagctgcttgaacggagcgacaatcctttctctaagggcattgcttatgtggaaggaaagctcgtcttacctagtgatgctagaataccgctactcgacgaaggtttcatgcatagtgacctaacctatgataccatatcggtttgggatggtcgcttctttcgattggatgatcatttgcaacggattttggaaagctgcgataagatgcggctcaagttcccacttgcactgagctcagtgaaaaatattctggctgagatggtcgccaagagtggtatccgggatgcgtttgtggaagttattgtgacacgtggtctgacaggtgtacgtggctcgaagcctgaggatctgtataataacaacatatacctgcttgttcttccatacatttggctgatggcgcctgagaaccagctccatggtggcgaggctatcattacaaggacagtgcgacgaacacccccaggtgcatttgatcctactatcaaaaatctacagtggggtgatttaattaagggaatgtttgaggcaatggaccgtggcgccacatacccatttctcactgatggagacaccaaccttactgaaggaccgggtttcaacattgttttggtgaagaacggtattatctatacccctgatcgaggtgtcttgcgagggatcacacgtaaaagtgtgattgacgttgcccgagccaacagcatcgacatccgccttgaggtcgtaccagtggagcaggcttatcactctgatgagatcttcatgtgcagcactggcggcggcattatgcctataacattgcttgatggtcaacctgttaatgacggccaggttggcccaatcacaaagaagatatgggatggctattgggagatgcactacaatccggcgtatagttttcctgttgactatggcagtggc

SEQ ID NO: 16 - protein, 323 aa, Artificial sequence
  Engineered sequence
MASMDKVFSGYYARQKLLERSDNPFSKGIAYVEGKLVLPSDARIPLLDEGFMHSDLTYDTISVWDGRFFRLDDHLQRILESCDKMRLKFPLALSSVKNILAEMVAKSGIRDAFVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGPGFNIVLVKNGIIYTPDRGVLRGITRKSVIDVARANSIDIRLEVVPVEQAYHSDEIFMCSTGGGIMPITLLDGQPVNDGQVGPITKKIWDGYWEMHYNPAYSFPVDYGSG

SEQ ID NO: 17 - DNA, 969 bp, Artificial sequence
  Engineered sequence
atggcctctatggacaaagtcttttcgggatattatgcgcgccagaagctgcttgaacggagcgacaatcctttctctaagggcattgcttatgtggaaggaaagctcgtcttacctagtgatgctagaataccgctactcgacgaaggtttcatgaccagtgacctaacctatgataccatatcggtttgggatggtcgcttctttcgattggatgatcatttgcaacggattttggaaagctgcgataagatgcggctcaagttcccacttgcactgagctcagtgaaaaatattctggctgagatggtcgccaagagtggtatccgggatgcgtttgtggaagttattgtgacacgtggtctgacaggtgtacgtggctcgaagcctgaggatctgtataataacaacatatacctgcttgttcttccatacatttggctgatggcgcctgagaaccagctccatggtggcgaggctatcattacaaggacagtgcgacgaacacccccaggtgcatttgatcctactatcaaaaatctacagtggggtgatttaattaagggaatgtttgaggcaatggaccgtggcgccacatacccatttctcactgatggagacaccaaccttactgaaggaccgggtttcaacattgttttggtgaagaacggtattatctatacccctgatcgaggtgtcttgcgagggatcacacgtaaaagtgtgattgacgttgcccgagccaacagcatcgacatccgccttgaggtcgtaccagtggagcaggcttatcactctgatgagatcttcatgtgcagcactgccggcggcattatgcctataacattgcttgatggtcaacctgttaatgacggccaggttggcccaatcacaaagaagatatgggatggctattgggagatgcactacaatccggcgtatagttttcctgttgactatggcagtggc

SEQ ID NO: 18 - protein, 323 aa, Artificial sequence
  Engineered sequence
MASMDKVFSGYYARQKLLERSDNPFSKGIAYVEGKLVLPSDARIPLLDEGFMTSDLTYDTISVWDGRFFRLDDHLQRILESCDKMRLKFPLALSSVKNILAEMVAKSGIRDAFVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGPGFNIVLVKNGIIYTPDRGVLRGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 19 - DNA, 969 bp, Artificial sequence
  Engineered sequence
atggcctctatggacaaagtcttttcgggatattatgcgcgccagaagctgcttgaacggagcgacaatcctttctctaagggcattgcttatgtggaaggaaagctcgtcttacctagtgatgctagaataccgctactcgacgaaggtttcatgaccagtgacctaacctatgataccatatcggtttgggatggtcgcttctttcgattggatgatcatttgcaacggattttggaaagctgcgataagatgcggctcaagttcccacttgcactgagctcagtgaaaaatattctggctgagatggtcgccaagagtggtatccgggatgcgatggtggaagttattgtgacacgtggtctgacaggtgtacgtttttcgaagcctgaggatctgtataataacaacatatacctgcttgttcttccatacatttggctgatggcgcctgagaaccagctccatggtggcgaggctatcattacaaggacagtgcgacgaacacccccaggtgcatttgatcctactatcaaaaatctacagtggggtgatttaattaagggaatgtttgaggcaatggaccgtggcgccacatacccatttctcactgatggagacaccaaccttactgaaggaccgggtttcaacattgttttggtgaagaacggtattatctatacccctgatcgaggtgtcttgcgagggatcacacgtaaaagtgtgattgacgttgcccgagccaacagcatcgacatccgccttgaggtcgtaccagtggagcaggcttatcactctgatgagatcttcatgtgcagcactgccggcggcattatgcctataacattgcttgatggtcaacctgttaatgacggccaggttggtccaatcacaaagaagatatgggatggctattgggagatgcactacaatccggcgtatagttttcctgttgactatggcagtggc

SEQ ID NO: 20 - protein, 323 aa, Artificial sequence
  Engineered sequence
MASMDKVFSGYYARQKLLERSDNPFSKGIAYVEGKLVLPSDARIPLLDEGFMTSDLTYDTISVWDGRFFRLDDHLQRILESCDKMRLKFPLALSSVKNILAEMVAKSGIRDAMVEVIVTRGLTGVRFSKPEDLYNNNIYLLVLPYIWLMAPENQLHGGEAIITRTVRRTPPGAFDPTIKNLQWGDLIKGMFEAMDRGATYPFLTDGDTNLTEGPGFNIVLVKNGIIYTPDRGVLRGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 21 - DNA, 969 bp, Artificial sequence
  Engineered sequence
atggcctctatggacaaagtcttttcgggatattatgcgcgccagaagctgcttgaacggagcgacaatcctttctctaagggcattgcttatgtggaaggaaagctcgtcttacctagtgatgctagaataccgctactcgacgaaggtttcatgcatagtgacctaacctatgataccatatcggtttgggatggtcgcttctttcgattggatgatcatttgcaacggattttggaaagctgcgataagatgcggctcaagttcccacttgcactgagctcagtgaaaaatattctggctgagatggtcgccaagagtggtatccgggatgcgtttgtggaagttattgtgacacgtggtctgacaggtgtacgtggctcgaagcctgaggatctgtataataacaacatatacctgcttgttcttccatacatttggctgatggcgcctgagaaccagctccatggtggcgaggctatcattacaaggacagtgcgacgaacacccccaggtgcatttgatcctactatcaaaaatctacagtggggtgatttaattaagggaatgtttgaggcaatggaccgtggcgccacatacccatttctcactgatggagacaccaaccttactgaaggaccgggtttcaacattgttttggtgaagaacggtattatctatacccctgatcgaggtgtcttgcgagggatcacacgtaaaagtgtgattgacgttgcccgagccaacagcatcgacatccgccttgaggtcgtaccagtggagcaggcttatcactctgatgagatcttcatgtgcaccactgccggcggcattatgcctataacattgcttgatggtcaacctgttaatgacggccaggttggcccaatcacaaagaagatatgggatggctattgggagatgcactacaatccggcgtatagttttcctgttgactatggcagtggc

SEQ ID NO: 22 - protein, 323 aa, Artificial sequence
  Engineered sequence
MASMDKVFSGYYARQKLLERSDNPFSKGIAYVEGKLVLPSDARIPLLDEGFMHSDLTYDTISVWDGRFFRLDDHLQRILESCDKMRLKFPLALSSVKNILAEMVAKSGIRDAFVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGPGFNIVLVKNGIIYTPDRGVLRGITRKSVIDVARANSIDIRLEVVPVEQAYHSDEIFMCTTAGGIMPITLLDGQPVNDGQVGPITKKIWDGYWEMHYNPAYSFPVDYGSG

SEQ ID NO: 23 - DNA, 969 bp, Artificial sequence
  Engineered sequence
atggcctctatggacaaagtcttttcgggatattatgcgcgccagaagctgcttgaacggagcgacaatcctttctctaagggcattgcttatgtggaaggaaagctcgtcttacctagtgatgctagaataccgctactcgacgaaggtttcatgcctagtgacctaacctatgataccatatcggtttgggatggtcgcttctttcgattgggcgatcatttgcaacggattttggaaagctgcgataagatgcggctcaagttcccacttgcactgagctcagtgaaaaatattctggctgagatggtcgccaagagtggtatccgggatgcgatggtggaagttattgtgacacgtggtctgacaggtgtacgtggctcgaagcctgaggatctgtataataacaacatatacctgcttgttcttccatacatttggctgatggcgcctgagaaccagctccatggtggcgaggctatcattacaaggacagtgcgacgaacacccccaggtgcatttgatcctactatcaaaaatctacagtggggtgatttaattaagggaatgtttgaggcaatggaccgtggcgccacatacccatttctcactgatggagacaccaaccttactgaaggatgcggtttcaacattgttttggtgaagaacggtattatctatacccctgatcgaggtgtcttgcgagggatcacacgtaaaagtgtgattgacgttgcccgagccaacagcatcgacatccgccttgaggtcgtaccagtggagcaggcttatcactctgatgagatcttcatgtgcagcactgccggcggcattatgcctataacattgcttgatggtcaacctgttaatgacggccaggttggcccaatcacaaagaagatatgggatggctattgggagatgcactacaatccggcgtatagttttcctgttgactatggcagtggc

SEQ ID NO: 24 - protein, 323 aa, Artificial sequence
  Engineered sequence
MASMDKVFSGYYARQKLLERSDNPFSKGIAYVEGKLVLPSDARIPLLDEGFMPSDLTYDTISVWDGRFFRLGDHLQRILESCDKMRLKFPLALSSVKNILAEMVAKSGIRDAMVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGCGFNIVLVKNGIIYTPDRGVLRGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 25 - DNA, 969 bp, Artificial sequence
  Engineered sequence
atggcctctatggacaaagtcttttcgggatattatgcgcgccagaagctgcttgaacggagcgacaatcctttctctaagggcattgcttatgtggaaggaaagctcgtcttacctagtgatgctagaataccgctactcgacgaaggtttcatgcatagtgacctaacctatgataccatatcggtttgggatggtcgcttctttcgattggatgatcatttgcaacggattttggaaagctgcgataagatgcggctcaagttcccacttgcactgagctcagtgaaaaatattctggctgagatggtcgccaagagtggtatccgggatgcgtttgtggaagttattgtgacacgtggtctgacaggtgtacgtggctcgaagcctgaggatctgtataataacaacatatacctgcttgttcttccatacatttggctgatggcgcctgagaaccagctccatggtggcgaggctatcattacaaggacagtgcgacgaacacccccaggtgcatttgatcctactatcaaaaatctacagtggggtgatttaattaagggaatgtttgaggcaatggaccgtggcgccacatacccatttctcactgatggagacaccaaccttactgaaggaccgggtttcaacattgttttggtgaagaacggtattatctatacccctgatcgaggtgtcttgcgagggatcacacgtaaaagtgtgattgacgttgcccgagccaacagcatcgacatccgccttgaggtcgtaccagtggagcaggcttatcactctgatgagatcttcatgtgcagcactgccggcggcattatgcctataacattgcttgatggtcaacctgttaatgacggccaggttggcccaatcacaaagaagatatgggatggctattgggagatgcactacaatccggcgtatagttttcctgttgactatggcagtggc

SEQ ID NO: 26 - protein, 323 aa, Artificial sequence
  Engineered sequence
MASMDKVFSGYYARQKLLERSDNPFSKGIAYVEGKLVLPSDARIPLLDEGFMHSDLTYDTISVWDGRFFRLDDHLQRILESCDKMRLKFPLALSSVKNILAEMVAKSGIRDAFVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGPGFNIVLVKNGIIYTPDRGVLRGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 27 - DNA, 969 bp, Artificial sequence
  Engineered sequence
atggcctctatggacaaagtcttttcgggatattatgcgcgccagaagctgcttgaacggagcgacaatcctttctctaagggcattgcttatgtggaaggaaagctcgtcttacctagtgatgctagaataccgctactcgacgaaggtttcatgcatagtgacctaacctatgataccatatcggtttgggatggtcgcttctttcgattggatgatcatttgcaacggattttggaaagctgcgataagatgcggctcaagttcccacttgcactgagctcagtgaaaaatattctggctgagatggtcgccaagagtggtatccgggatgcgatggtggaagttattgtgacacgtggtctgacaggtgtacgtggctcgaagcctgaggatctgtataataacaacatatacctgcttgttcttccatacatttggctgatggcgcctgagaaccagctccatggtggcgaggctatcattacaaggacagtgcgacgaacacccccaggtgcatttgatcctactatcaaaaatctacagtggggtgatttaattaagggaatgtttgaggcaatggaccgtggcgccacatacccatttctcactgatggagacaccaaccttactgaaggatgcggtttcaacattgttttggtgaagaacggtattatctatacccctgatcgaggtgtcttgcgagggatcacacgtaaaagtgtgattgacgttgcccgagccaacagcatcgacatccgccttgaggtcgtaccagtggagcaggcttatcactctgatgagatcttcatgtgcagcactgccggcggcattatgcctataacattgcttgatggtcaacctgttaatgacggccaggttggcccaatcacaaagaagatatgggatggctattgggagatgcactacaatccggcgtatagttttcctgttgactatggcagtggc

SEQ ID NO: 28 - protein, 323 aa, Artificial sequence
  Engineered sequence
MASMDKVFSGYYARQKLLERSDNPFSKGIAYVEGKLVLPSDARIPLLDEGFMHSDLTYDTISVWDGRFFRLDDHLQRILESCDKMRLKFPLALSSVKNILAEMVAKSGIRDAMVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGCGFNIVLVKNGIIYTPDRGVLRGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 29 - DNA, 969 bp, Artificial sequence
  Engineered sequence
atggcctctatggacaaagtcttttcgggatattatgcgcgccagaagctgcttgaacggagcgacaatcctttctctaagggcattgcttatgtggaaggaaagctcgtcttacctagtgatgctagaataccgctactcgacgaaggtttcatgcatagtgacctaacctatgataccatatcggtttgggatggtcgcttctttcgattggatgatcatttgcaacggattttggaaagctgcgataagatgcggctcaagttcccacttgcactgagctcagtgaaaaatattctggctgagatggtcgccaagagtggtatccgggatgcgatggtggaagttattgtgacacgtggtctgacaggtgtacgtttttcgaagcctgaggatctgtataataacaacatatacctgcttgttcttccatacatttggctgatggcgcctgagaaccagctccatggtggcgaggctatcattacaaggacagtgcgacgaacacccccaggtgcatttgatcctactatcaaaaatctacagtggggtgatttaattaagggaatgtttgaggcaatggaccgtggcgccacatacccatttctcactgatggagacaccaaccttactgaaggatgcggtttcaacattgttttggtgaagaacggtattatctatacccctgatcgaggtgtcttgcgagggatcacacgtaaaagtgtgattgacgttgcccgagccaacagcatcgacatccgccttgaggtcgtaccagtggagcaggcttatcactctgatgagatcttcatgtgcagcactgccggcggcattatgcctataacattgcttgatggtcaacctgttaatgacggccaggttggcccaatcacaaagaagatatgggatggctattgggagatgcactacaatccggcgtatagttttcctgttgactatggcagtggc

SEQ ID NO: 30 - protein, 323 aa, Artificial sequence
  Engineered sequence
MASMDKVFSGYYARQKLLERSDNPFSKGIAYVEGKLVLPSDARIPLLDEGFMHSDLTYDTISVWDGRFFRLDDHLQRILESCDKMRLKFPLALSSVKNILAEMVAKSGIRDAMVEVIVTRGLTGVRFSKPEDLYNNNIYLLVLPYIWLMAPENQLHGGEAIITRTVRRTPPGAFDPTIKNLQWGDLIKGMFEAMDRGATYPFLTDGDTNLTEGCGFNIVLVKNGIIYTPDRGVLRGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 31 - DNA, 969 bp, Artificial sequence
  Engineered sequence
atggcctctatggacaaagtcttttcgggatattatgcgcgccagaagctgcttgaacggagcgacaatcctttctctaagggcattgcttatgtggaaggaaagctcgtcttacctagtgatgctagaataccgctactcgacgaaggtttcatgaccagtgacctaacctatgataccatatcggtttgggatggtcgcttctttcgattggatgatcatttgcaacggattttggaaagctgcgataagatgcggctcaagttcccacttgcactgagctcagtgaaaaatattctggctgagatggtcgccaagagtggtatccgggatgcgtttgtggaagttattgtgacacgtggtctgacaggtgtacgtggctcgaagcctgaggatctgtataataacaacatatacctgcttgttcttccatacatttggctgatggcgcctgagaaccagctccatggtggcgaggctatcattacaaggacagtgcgacgaacacccccaggtgcatttgatcctactatcaaaaatctacagtggggtgatttaattaagggaatgtttgaggcaatggaccgtggcgccacatacccatttctcactgatggagacaccaaccttactgaaggaccgggtttcaacattgttttggtgaagaacggtattatctatacccctgatcgaggtgtcttgcgagggatcacacgtaaaagtgtgattgacgttgcccgagccaacagcatcgacatccgccttgaggtcgtaccagtggagcaggcttatcactctgatgagatcttcatgtgcagcactggcggcggcattatgcctataacattgcttgatggtcaacctgttaatgacggccaggttggcccaatcacaaagaagatatgggatggctattgggagatgcactacaatccggcgtatagttttcctgttgactatggcagtggc

SEQ ID NO: 32 - protein, 323 aa, Artificial sequence
  Engineered sequence
MASMDKVFSGYYARQKLLERSDNPFSKGIAYVEGKLVLPSDARIPLLDEGFMTSDLTYDTISVWDGRFFRLDDHLQRILESCDKMRLKFPLALSSVKNILAEMVAKSGIRDAFVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGPGFNIVLVKNGIIYTPDRGVLRGITRKSVIDVARANSIDIRLEVVPVEQAYHSDEIFMCSTGGGIMPITLLDGQPVNDGQVGPITKKIWDGYWEMHYNPAYSFPVDYGSG

SEQ ID NO: 33 - DNA, 969 bp, Artificial sequence
  Engineered sequence
atggcctctatggacaaagtcttttcgggatattatgcgcgccagaagctgcttgaacggagcgacaatcctttctctaagggcattgcttatgtggaaggaaagctcgtcttacctagtgatgctagaataccgctactcgacgaaggtttcatgcacagtgacctaacctatgatgttatatcggtttgggatggtcgcttctttcgattggacgatcatttgcaacggattttggaaagctgcgataagatgcggctcaagttcccacttgcactgagctcagtgaaaaatattctggctgagatggtcgccaagagtggtatccgggatgcgtgggtggaagttattgtgacacgtggtctgacaggtgtacgtggttcgaagcctgaggatctgtataataacaacatatacctgcttgttcttccatacatttggctgatggcgcctgagaaccagctccatggtggcgaggctatcattacaaggacagtgcgacgaacacccccaggtgcatttgatcctactatcaaaaatctacagtggggtgatttaattaagggaatgtttgaggcaatggaccgtggcgccacatacccatttctcactgatggagacaccaaccttactgaaggatgcggtttcaacattgttttggtgaagaacggtattatctatacccctgatcgaggtgtcttgcgagggatcacacgtaaaagtgtgattgacgttgcccgagccaacagcatcgacatccgccttgaggtcgtaccagtggagcaggcttatcactctgatgagatcttcatgtgcacaactgccggcggcattatgcctataacattgcttgatggtcaacctgttaatgacggccaggttggcccaatcacaaagaagatatgggatggctattgggagatgcactacaatccggcgtatagttttcctgttgactatggcagtggc

SEQ ID NO: 34 - protein, 323 aa, Artificial sequence
  Engineered sequence
MASMDKVFSGYYARQKLLERSDNPFSKGIAYVEGKLVLPSDARIPLLDEGFMHSDLTYDVISVWDGRFFRLDDHLQRILESCDKMRLKFPLALSSVKNILAEMVAKSGIRDAWVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGCGFNIVLVKNGIIYTPDRGVLRGITRKSVIDVARANSIDIRLEVVPVEQAYHSDEIFMCTTAGGIMPITLLDGQPVNDGQVGPITKKIWDGYWEMHYNPAYSFPVDYGSG

SEQ ID NO: 35 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatggccagcgacctgacctacgacacgatccgcgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaaggtcattgttacccgcggtctgaccggcgttcagggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatttcatcaaaggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 36 - protein, 323 aa, Artificial sequence
  Engineered sequence
MATIDKVFAGYYARQKLLERSDNPFSKGIAYVEGKFVLPYEARIPLLDEGFMASDLTYDTIRVWDGRFFRLDDHLQRILESCDKMRLKFPLALSSVKKILVEMVAKSGIRDAMVKVIVTRGLTGVQGRKPEDLYNNNIYLLVLPYIWLMAPEDQSHGGSAIITRTVRRTPPGAFDPTIKNLQWGDFIKGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 37 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgaccagcgacctgacctacgacacgttcagcgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaaggtcattgttacccgcggtctgaccggcgttcgtggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatttcaaccgtggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 38 - protein, 323 aa, Artificial sequence
  Engineered sequence
MATIDKVFAGYYARQKLLERSDNPFSKGIAYVEGKFVLPYEARIPLLDEGFMTSDLTYDTFSVWDGRFFRLDDHLQRILESCDKMRLKFPLALSSVKKILVEMVAKSGIRDAMVKVIVTRGLTGVRGRKPEDLYNNNIYLLVLPYIWLMAPEDQSHGGSAIITRTVRRTPPGAFDPTIKNLQWGDFNRGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 39 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgcgcagcgacctgacctacgacacgatccacgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaaggtcattgttacccgcggtctgaccggcgttcagggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatctcaaccgtggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 40 - protein, 323 aa, Artificial sequence
  Engineered sequence
MATIDKVFAGYYARQKLLERSDNPFSKGIAYVEGKFVLPYEARIPLLDEGFMRSDLTYDTIHVWDGRFFRLDDHLQRILESCDKMRLKFPLALSSVKKILVEMVAKSGIRDAMVKVIVTRGLTGVQGRKPEDLYNNNIYLLVLPYIWLMAPEDQSHGGSAIITRTVRRTPPGAFDPTIKNLQWGDLNRGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 41 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgggcagcgacctgacctacgacacgttcagcgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaagatcattgttacccgcggtctgaccggcgttcagggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatttcaacaaaggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 42 - protein, 323 aa, Artificial sequence
  Engineered sequence
MATIDKVFAGYYARQKLLERSDNPFSKGIAYVEGKFVLPYEARIPLLDEGFMGSDLTYDTFSVWDGRFFRLDDHLQRILESCDKMRLKFPLALSSVKKILVEMVAKSGIRDAMVKIIVTRGLTGVQGRKPEDLYNNNIYLLVLPYIWLMAPEDQSHGGSAIITRTVRRTPPGAFDPTIKNLQWGDFNKGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 43 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgaacagcgacctgacctacgacacgatcagcgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaaggtcattgttacccgcggtctgaccggcgttcagggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatttcatccgtggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 44 - protein, 323 aa, Artificial sequence
  Engineered sequence
MATIDKVFAGYYARQKLLERSDNPFSKGIAYVEGKFVLPYEARIPLLDEGFMNSDLTYDTISVWDGRFFRLDDHLQRILESCDKMRLKFPLALSSVKKILVEMVAKSGIRDAMVKVIVTRGLTGVQGRKPEDLYNNNIYLLVLPYIWLMAPEDQSHGGSAIITRTVRRTPPGAFDPTIKNLQWGDFIRGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 45 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgaccagcgacctgacctacgacacgttccacgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaagatcattgttacccgcggtctgaccggcgttcagggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatctcaacaaaggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 46 - protein, 323 aa, Artificial sequence
  Engineered sequence
MATIDKVFAGYYARQKLLERSDNPFSKGIAYVEGKFVLPYEARIPLLDEGFMTSDLTYDTFHVWDGRFFRLDDHLQRILESCDKMRLKFPLALSSVKKILVEMVAKSGIRDAMVKIIVTRGLTGVQGRKPEDLYNNNIYLLVLPYIWLMAPEDQSHGGSAIITRTVRRTPPGAFDPTIKNLQWGDLNKGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 47 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgaccagcgacctgacctacgacacgatccacgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaagatcattgttacccgcggtctgaccggcgttcgtggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatttcatccgtggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 48 - protein, 323 aa, Artificial sequence
  Engineered sequence
MATIDKVFAGYYARQKLLERSDNPFSKGIAYVEGKFVLPYEARIPLLDEGFMTSDLTYDTIHVWDGRFFRLDDHLQRILESCDKMRLKFPLALSSVKKILVEMVAKSGIRDAMVKIIVTRGLTGVRGRKPEDLYNNNIYLLVLPYIWLMAPEDQSHGGSAIITRTVRRTPPGAFDPTIKNLQWGDFIRGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 49 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgcgcagcgacctgacctacgacacgatcagcgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcgaggtcattgttacccgcggtctgaccggcgttcagggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatttcaacaaaggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 50 - protein, 323 aa, Artificial sequence
  Engineered sequence
MATIDKVFAGYYARQKLLERSDNPFSKGIAYVEGKFVLPYEARIPLLDEGFMRSDLTYDTISVWDGRFFRLDDHLQRILESCDKMRLKFPLALSSVKKILVEMVAKSGIRDAMVEVIVTRGLTGVQGRKPEDLYNNNIYLLVLPYIWLMAPEDQSHGGSAIITRTVRRTPPGAFDPTIKNLQWGDFNKGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 51 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgaccagcgacctgacctacgacacgatcagcgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcgagatcattgttacccgcggtctgaccggcgttcagggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatttcatcaaaggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 52 - protein, 323 aa, Artificial sequence
  Engineered sequence
MATIDKVFAGYYARQKLLERSDNPFSKGIAYVEGKFVLPYEARIPLLDEGFMTSDLTYDTISVWDGRFFRLDDHLQRILESCDKMRLKFPLALSSVKKILVEMVAKSGIRDAMVEIIVTRGLTGVQGRKPEDLYNNNIYLLVLPYIWLMAPEDQSHGGSAIITRTVRRTPPGAFDPTIKNLQWGDFIKGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 53 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgaccagcgacctgacctacgacacgttcaacgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaaggtcattgttacccgcggtctgaccggcgttcgtggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatttcaaccgtggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 54 - protein, 323 aa, Artificial sequence
  Engineered sequence
MATIDKVFAGYYARQKLLERSDNPFSKGIAYVEGKFVLPYEARIPLLDEGFMTSDLTYDTFNVWDGRFFRLDDHLQRILESCDKMRLKFPLALSSVKKILVEMVAKSGIRDAMVKVIVTRGLTGVRGRKPEDLYNNNIYLLVLPYIWLMAPEDQSHGGSAIITRTVRRTPPGAFDPTIKNLQWGDFNRGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 55 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgggcagcgacctgacctacgacacgatcagcgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaagatcattgttacccgcggtctgaccggcgttcgtggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatttcatcaaaggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 56 - protein, 323 aa, Artificial sequence
  Engineered sequence
MATIDKVFAGYYARQKLLERSDNPFSKGIAYVEGKFVLPYEARIPLLDEGFMGSDLTYDTISVWDGRFFRLDDHLQRILESCDKMRLKFPLALSSVKKILVEMVAKSGIRDAMVKIIVTRGLTGVRGRKPEDLYNNNIYLLVLPYIWLMAPEDQSHGGSAIITRTVRRTPPGAFDPTIKNLQWGDFIKGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 57 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgagcagcgacctgacctacgacacgatcagcgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatgggcaaggtcattgttacccgcggtctgaccggcgttcagggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatttcaaccgtggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 58 - protein, 323 aa, Artificial sequence
  Engineered sequence
MATIDKVFAGYYARQKLLERSDNPFSKGIAYVEGKFVLPYEARIPLLDEGFMSSDLTYDTISVWDGRFFRLDDHLQRILESCDKMRLKFPLALSSVKKILVEMVAKSGIRDAMGKVIVTRGLTGVQGRKPEDLYNNNIYLLVLPYIWLMAPEDQSHGGSAIITRTVRRTPPGAFDPTIKNLQWGDFNRGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 59 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgcacagcgacctgacctacgacacgatcagcgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaaggtcattgttacccgcggtctgaccggcgttcagggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatttcaaccgtggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 60 - protein, 323 aa, Artificial sequence
  Engineered sequence
MATIDKVFAGYYARQKLLERSDNPFSKGIAYVEGKFVLPYEARIPLLDEGFMHSDLTYDTISVWDGRFFRLDDHLQRILESCDKMRLKFPLALSSVKKILVEMVAKSGIRDAMVKVIVTRGLTGVQGRKPEDLYNNNIYLLVLPYIWLMAPEDQSHGGSAIITRTVRRTPPGAFDPTIKNLQWGDFNRGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 61 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgggcagcgacctgacctacgacacgatccacgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcgagatcattgttacccgcggtctgaccggcgttcgtggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatttcaacaaaggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 62 - protein, 323 aa, Artificial sequence
  Engineered sequence
MATIDKVFAGYYARQKLLERSDNPFSKGIAYVEGKFVLPYEARIPLLDEGFMGSDLTYDTIHVWDGRFFRLDDHLQRILESCDKMRLKFPLALSSVKKILVEMVAKSGIRDAMVEIIVTRGLTGVRGRKPEDLYNNNIYLLVLPYIWLMAPEDQSHGGSAIITRTVRRTPPGAFDPTIKNLQWGDFNKGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 63 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatggccagcgacctgacctacgacacgatccacgtttgggacggtcgctttttccgtctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatgggcaagatcattgttacccgcggtctgaccggcgttcgtggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatctcaaccgtggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 64 - protein, 323 aa, Artificial sequence
  Engineered sequence
MATIDKVFAGYYARQKLLERSDNPFSKGIAYVEGKFVLPYEARIPLLDEGFMASDLTYDTIHVWDGRFFRLDDHLQRILESCDKMRLKFPLALSSVKKILVEMVAKSGIRDAMGKIIVTRGLTGVRGRKPEDLYNNNIYLLVLPYIWLMAPEDQSHGGSAIITRTVRRTPPGAFDPTIKNLQWGDLNRGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 65 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgcacagcgacctgacctacgacacgttcagcgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaagatcattgttacccgcggtctgaccggcgttcagggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatttcaaccgtggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 66 - protein, 323 aa, Artificial sequence
  Engineered sequence
MATIDKVFAGYYARQKLLERSDNPFSKGIAYVEGKFVLPYEARIPLLDEGFMHSDLTYDTFSVWDGRFFRLDDHLQRILESCDKMRLKFPLALSSVKKILVEMVAKSGIRDAMVKIIVTRGLTGVQGRKPEDLYNNNIYLLVLPYIWLMAPEDQSHGGSAIITRTVRRTPPGAFDPTIKNLQWGDFNRGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 67 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgaccagcgacctgacctacgacacgatccacgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaaggtcattgttacccgcggtctgaccggcgttcgtggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatctcaaccgtggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 68 - protein, 323 aa, Artificial sequence
  Engineered sequence
MATIDKVFAGYYARQKLLERSDNPFSKGIAYVEGKFVLPYEARIPLLDEGFMTSDLTYDTIHVWDGRFFRLDDHLQRILESCDKMRLKFPLALSSVKKILVEMVAKSGIRDAMVKVIVTRGLTGVRGRKPEDLYNNNIYLLVLPYIWLMAPEDQSHGGSAIITRTVRRTPPGAFDPTIKNLQWGDLNRGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 69 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatggccagcgacctgacctacgacacgatcaacgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaaggtcattgttacccgcggtctgaccggcgttcgtggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatttcatcaaaggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 70 - protein, 323 aa, Artificial sequence
  Engineered sequence
MATIDKVFAGYYARQKLLERSDNPFSKGIAYVEGKFVLPYEARIPLLDEGFMASDLTYDTINVWDGRFFRLDDHLQRILESCDKMRLKFPLALSSVKKILVEMVAKSGIRDAMVKVIVTRGLTGVRGRKPEDLYNNNIYLLVLPYIWLMAPEDQSHGGSAIITRTVRRTPPGAFDPTIKNLQWGDFIKGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 71 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgaacagcgacctgacctacgacacgatcaacgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaagatcattgttacccgcggtctgacaggcgttcagggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatttcatccgtggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 72 - protein, 323 aa, Artificial sequence
  Engineered sequence
MATIDKVFAGYYARQKLLERSDNPFSKGIAYVEGKFVLPYEARIPLLDEGFMNSDLTYDTINVWDGRFFRLDDHLQRILESCDKMRLKFPLALSSVKKILVEMVAKSGIRDAMVKIIVTRGLTGVQGRKPEDLYNNNIYLLVLPYIWLMAPEDQSHGGSAIITRTVRRTPPGAFDPTIKNLQWGDFIRGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 73 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgcacagcgacctgacctacgacacgatcagcgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaagatcattgttacccgcggtctgaccggcgttcgtggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatttcatccgtggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 74 - protein, 323 aa, Artificial sequence
  Engineered sequence
MATIDKVFAGYYARQKLLERSDNPFSKGIAYVEGKFVLPYEARIPLLDEGFMHSDLTYDTISVWDGRFFRLDDHLQRILESCDKMRLKFPLALSSVKKILVEMVAKSGIRDAMVKIIVTRGLTGVRGRKPEDLYNNNIYLLVLPYIWLMAPEDQSHGGSAIITRTVRRTPPGAFDPTIKNLQWGDFIRGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 75 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgaccagcgacctgacctacgacacgttcagcgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaagatcattgttacccgcggtctgaccggcgttcgtggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatctcatccgtggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 76 - protein, 323 aa, Artificial sequence
  Engineered sequence
MATIDKVFAGYYARQKLLERSDNPFSKGIAYVEGKFVLPYEARIPLLDEGFMTSDLTYDTFSVWDGRFFRLDDHLQRILESCDKMRLKFPLALSSVKKILVEMVAKSGIRDAMVKIIVTRGLTGVRGRKPEDLYNNNIYLLVLPYIWLMAPEDQSHGGSAIITRTVRRTPPGAFDPTIKNLQWGDLIRGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 77 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgagcagcgacctgacctacgacacgttccacgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaagatcattgttacccgcggtctgaccggcgttcagggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatctcatccgtggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 78 - protein, 323 aa, Artificial sequence
  Engineered sequence
MATIDKVFAGYYARQKLLERSDNPFSKGIAYVEGKFVLPYEARIPLLDEGFMSSDLTYDTFHVWDGRFFRLDDHLQRILESCDKMRLKFPLALSSVKKILVEMVAKSGIRDAMVKIIVTRGLTGVQGRKPEDLYNNNIYLLVLPYIWLMAPEDQSHGGSAIITRTVRRTPPGAFDPTIKNLQWGDLIRGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 79 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgaacagcgacctgacctacgacacgatcaacgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaagatcattgttacccgcggtctgaccggcgttcgtggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatttcatcaaaggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 80 - protein, 323 aa, Artificial sequence
  Engineered sequence
MATIDKVFAGYYARQKLLERSDNPFSKGIAYVEGKFVLPYEARIPLLDEGFMNSDLTYDTINVWDGRFFRLDDHLQRILESCDKMRLKFPLALSSVKKILVEMVAKSGIRDAMVKIIVTRGLTGVRGRKPEDLYNNNIYLLVLPYIWLMAPEDQSHGGSAIITRTVRRTPPGAFDPTIKNLQWGDFIKGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 81 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgaccagcgacctgacctacgacacgatccacgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcgaggtcattgttacccgcggtctgaccggcgttcagggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatctcaaccgtggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 82 - protein, 323 aa, Artificial sequence
  Engineered sequence
MATIDKVFAGYYARQKLLERSDNPFSKGIAYVEGKFVLPYEARIPLLDEGFMTSDLTYDTIHVWDGRFFRLDDHLQRILESCDKMRLKFPLALSSVKKILVEMVAKSGIRDAMVEVIVTRGLTGVQGRKPEDLYNNNIYLLVLPYIWLMAPEDQSHGGSAIITRTVRRTPPGAFDPTIKNLQWGDLNRGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 83 - DNA, 969 bp, Artificial sequence
  Engineered sequence
atggcaaccatagataaagtctttgcgggctattacgcgcgtcaaaaactgctggaacgctctgataacccgtttagcaaaggcatcgcgtacgttgaaggcaaatttgtcctgccgtacgaagcacgtattccgctgctggacgaaggttttatgcacagcgacctgacctacgacacgatcagcgtttgggacggtcgctttttccgcctggacgatcatctgcaacgtatcctggaatcctgcgacaaaatgcgcctgaaatttccgctggcactgagcagcgttaaaaaaatcctggttgaaatggttgcaaaaagcggtattcgcgacgcgatggtcaagatcattgttacccgcggtctgaccggcgttcgtggtcgcaaaccggaggacctgtacaacaacaacatctacctgctggttctgccgtatatctggctgatggcaccggaagaccaaagccacggcggttctgcgattattacccgtaccgttcgtcgtaccccgccgggcgcatttgatccgaccattaaaaacctgcagtggggcgatctcaacaaaggtatgtttgaagcgaaggatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatctttatgtgttcgaccggcggcggtattatgccgatcaccctgctggacggtaaaccggttaacgacggtcaggtaggcccgattaccaaaaagatttgggacggctactgggagatgcattataacgcggcgtacagctttccggtagattatggtagcgat

SEQ ID NO: 84 - protein, 323 aa, Artificial sequence
  Engineered sequence
MATIDKVFAGYYARQKLLERSDNPFSKGIAYVEGKFVLPYEARIPLLDEGFMHSDLTYDTISVWDGRFFRLDDHLQRILESCDKMRLKFPLALSSVKKILVEMVAKSGIRDAMVKIIVTRGLTGVRGRKPEDLYNNNIYLLVLPYIWLMAPEDQSHGGSAIITRTVRRTPPGAFDPTIKNLQWGDLNKGMFEAKDRGATYPFLTDGDTHLTEGPGFNIVLVKNGILYTPDRGVLEGITRKSVIEVARANSIDVRLEVVPVETAYHADEIFMCSTGGGIMPITLLDGKPVNDGQVGPITKKIWDGYWEMHYNAAYSFPVDYGSD

SEQ ID NO: 85 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttaatggtagtaaaccggaagacctgtacaacaacaacatctacctgctggttctgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 86 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMRLKFPLALSSVKNILAEMVAKSGIRDAMVEVIVTRGLTGVNGSKPEDLYNNNIYLLVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 87 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttgatggtagtaaaccggaagacctgtacaacaacaacatctacctgctggttctgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 88 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMRLKFPLALSSVKNILAEMVAKSGIRDAMVEVIVTRGLTGVDGSKPEDLYNNNIYLLVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 89 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcaagagtaaaccggaagacctgtacaacaacaacatctacctgctggttctgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 90 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMRLKFPLALSSVKNILAEMVAKSGIRDAMVEVIVTRGLTGVRKSKPEDLYNNNIYLLVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 91 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgctctagtaaaccggaagacctgtacaacaacaacatctacctgctggttctgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 92 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMRLKFPLALSSVKNILAEMVAKSGIRDAMVEVIVTRGLTGVRSSKPEDLYNNNIYLLVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 93 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcccgagtaaaccggaagacctgtacaacaacaacatctacctgctggttctgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 94 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMRLKFPLALSSVKNILAEMVAKSGIRDAMVEVIVTRGLTGVRPSKPEDLYNNNIYLLVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 95 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgcaggttctgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 96 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMRLKFPLALSSVKNILAEMVAKSGIRDAMVEVIVTRGLTGVRGSKPEDLYNNNIYLQVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 97 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgacggttctgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 98 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMRLKFPLALSSVKNILAEMVAKSGIRDAMVEVIVTRGLTGVRGSKPEDLYNNNIYLTVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 99 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggtttcgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 100 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMRLKFPLALSSVKNILAEMVAKSGIRDAMVEVIVTRGLTGVRGSKPEDLYNNNIYLLVSPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 101 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttcggccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 102 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMRLKFPLALSSVKNILAEMVAKSGIRDAMVEVIVTRGLTGVRGSKPEDLYNNNIYLLVRPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 103 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggcaggtttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 104 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMRLKFPLALSSVKNILAEMVAKSGIRDAMVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 105 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaaaatcaactgcacggcggcgaagcaattattacccgtaccgttgttcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 106 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMRLKFPLALSSVKNILAEMVAKSGIRDAMVEVIVTRGLTGVRGSKPEDLYNNNIYLLVLPYIWLMAPENQLHGGEAIITRTVVRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 107 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaaaatcaactgcacggcggcgaagcaattattacccgtaccgttcgtcgtaccccgccgggcgcattttatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 108 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMRLKFPLALSSVKNILAEMVAKSGIRDAMVEVIVTRGLTGVRGSKPEDLYNNNIYLLVLPYIWLMAPENQLHGGEAIITRTVRRTPPGAFYPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 109 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgtttagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 110 - protein, 323 aa, Artificial sequence
  Engineered sequence
MASMDKVFSGYYARQKLLERSDNPFSKGIAYVEGKLVLPSDARIPLLDEGFMFSDATYDTISVWDGRFFRLDDHLQRILESCDKMRLKFPLALSSVKNILAEMVAKSGIRDAMVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 111 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgttgagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 112 - protein, 323 aa, Artificial sequence
  Engineered sequence
MASMDKVFSGYYARQKLLERSDNPFSKGIAYVEGKLVLPSDARIPLLDEGFMLSDATYDTISVWDGRFFRLDDHLQRILESCDKMRLKFPLALSSVKNILAEMVAKSGIRDAMVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 113 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacagtaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 114 - protein, 323 aa, Artificial sequence
  Engineered sequence
MASMDKVFSGYYARQKLLERSDNPFSKGIAYVEGKLVLPSDARIPLLDEGFMHSDATYSTISVWDGRFFRLDDHLQRILESCDKMRLKFPLALSSVKNILAEMVAKSGIRDAMVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 115 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 116 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 117 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 118 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 119 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattgcggtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 120 - protein, 323 aa, Artificial sequence
  Engineered sequence
MASMDKVFSGYYARQKLLERSDNPFSKGIAYVEGKLVLPSDARIPLLDEGFMHSDATYDTIAVWDGRFFRLDDHLQRILESCDKMRLKFPLALSSVKNILAEMVAKSGIRDAMVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 121 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtccatgttattgttacccgcggtctgaccggcgttcgcggtagtaaaccggaagacctgtacaacaacaacatctacctgctggttctgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 122 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMRLKFPLALSSVKNILAEMVAKSGIRDAMVHVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 123 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtctatgttattgttacccgcggtctgaccggcgttcgcggtagtaaaccggaagacctgtacaacaacaacatctacctgctggttctgccgtatatctggctgatggcacctgaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 124 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMRLKFPLALSSVKNILAEMVAKSGIRDAMVYVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 125 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtctttgttattgttacccgcggtctgaccggcgttcgcggtagtaaaccggaagacctgtacaacaacaacatctacctgctggttctgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 126 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMRLKFPLALSSVKNILAEMVAKSGIRDAMVFVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 127 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtgatagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 128 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMRLKFPLALSSVKNILAEMVAKSGIRDAMVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRDSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 129 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggccgctttttccgtctggacgatcatctgcagcgtattctggaatcctgcgacaaaatgtgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtagtagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 130 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMCLKFPLALSSVKNILAEMVAKSGIRDAMVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRSSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 131 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaaaatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtcagagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 132 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMRLKFPLALSSVKNILAEMVAKSGIRDAMVEVIVTRGLTGVRGSKPEDLYNNNIYLLVLPYIWLMAPENQLHGGEAIITRTVRRTPPGAFDPTIKNLQWGDLIKGMFEAMDRGATYPFLTDGDTNLTEGSGFNIVLVKNGIIYTPDRGVLEGITRQSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 133 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacgacaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaaaatcaactgcacggcggcgaagcaattattacccgtaccgttcgtcgtaccccgccgggcgcatctgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacgacggtcaggtaggcccgattaccaaaaagatttgggacggctactgggagatgcattacaatccggcgtatagctttccggtcgattacggtagcggt

SEQ ID NO: 134 - protein, 323 aa, Artificial sequence
  Engineered sequence
MASMDKVFSGYYARQKLLERSDNPFSKGIAYVEGKLVLPSDARIPLLDEGFMHSDATYDTISVWDGRFFRLDDHLQRILESCDKMRLKFPLALSSVKNILAEMVAKSGIRDAMVEVIVTRGLTGVRGSKPEDLYNNNIYLLVLPYIWLMAPENQLHGGEAIITRTVRRTPPGASDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNDGQVGPITKKIWDGYWEMHYNPAYSFPVDYGSG

SEQ ID NO: 135 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgaggaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 136 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLRKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 137 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcattggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 138 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEALDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 139 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcaaaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 140 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAKDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 141 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcaattgatccgacgattaaaaactaccaatggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 142 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAIDPTIKNYQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 143 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaactttcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 144 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNFQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 145 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcacgtgatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 146 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEARDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 147 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 148 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 149 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattccgattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 150 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIPIRLEVVPVEQAYHSDEIFMCSTAGGIMPITLLDGQPVNGGQVGPITKKIWDGYWEMHYNPAYSFPVDYGSG

SEQ ID NO: 151 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 152 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 153 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactggaatatgcattacaatccggcgtatagctttccggtcgattacggtagcggt

SEQ ID NO: 154 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWNMHYNPAYSFPVDYGSG

SEQ ID NO: 155 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 156 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 157 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctgcatgaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 158 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILHEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 159 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgtctggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 160 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLSGVRGSKPEDLYNNNIYLLVLPYIWLMAPEDQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 161 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtaataaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 162 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGNKPEDLYNNNIYLLVLPYIWLMAPEDQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 163 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaaaatcaactgttgggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 164 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPENQLLGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 165 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaaaatcaactgattggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 166 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPENQLIGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 167 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgatacccatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 168 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAMDRGATYPFLTDGDTHLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 169 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagctgcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 170 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEAAYHSDEIFMCSTAGGIMPITLLDGQPVNGGQVGPITKKIWDGYWEMHYNPAYSFPVDYGSG

SEQ ID NO: 171 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaatttgcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 172 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEFAYHSDEIFMCSTAGGIMPITLLDGQPVNGGQVGPITKKIWDGYWEMHYNPAYSFPVDYGSG

SEQ ID NO: 173 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacgctgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 174 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHADEIFMCSTAGGIMPITLLDGQPVNGGQVGPITKKIWDGYWEMHYNPAYSFPVDYGSG

SEQ ID NO: 175 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaaattattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 176 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEIIVTRGLTGVRGSKPEDLYNNNIYLLVLPYIWLMAPEDQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 177 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccggcgttcgcggtcgcaaccaggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaacctgcagtggggcgatctgatcaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaatcccgcgtatagctttccggtcgattacggtagcggt

SEQ ID NO: 178 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKKILAEMVAKSGIRDAMVEVIVTRGLTGVRGRNQEDLYNNNIYLLVLPYIWLMAPEDQLHGGEAIITRTVRRTPPGAFDPTIKNLQWGDLIKGMFEAMDRGATYPFLTDGDTHLTEGSGFNIVLVKNGIIYTPDRGVLEGITRKSVIDVARANSIDIRLEVVPVEQAYHSDEIFMTSTAGGIMPITLLDGQPVNGGQVGPITKKIWDGYWEMHYNPAYSFPVDYGSG

SEQ ID NO: 179 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtcgccaagaggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaacctgcagtggggcgatctgatcaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgcagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 180 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGRQEEDLYNNNIYLLVLPYIWLMAPEDQLHGGEAIITRTVRRTPPGAFDPTIKNLQWGDLIKGMFEAMDRGATYPFLTDGDTHLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNNAYSFPVDYGSG

SEQ ID NO: 181 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtcgccaacaggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaacctgcagtggggcgatctgatcaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgcagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 182 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGRQQEDLYNNNIYLLVLPYIWLMAPEDQLHGGEAIITRTVRRTPPGAFDPTIKNLQWGDLIKGMFEAMDRGATYPFLTDGDTHLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNNAYSFPVDYGSG

SEQ ID NO: 183 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagcaaacaggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaacctgcagtggggcgatctgatcaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 184 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKQEDLYNNNIYLLVLPYIWLMAPEDQLHGGEAIITRTVRRTPPGAFDPTIKNLQWGDLIKGMFEAMDRGATYPFLTDGDTHLTEGSGFNIVLVKNGIIYTPDRGVLEGITRKSVIDVARANSIDIRLEVVPVEQAYHSDEIFMTSTAGGIMPITLLDGQPVNGGQVGPITKKIWDGYWEMHYNNAYSFPVDYGSG

SEQ ID NO: 185 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtcgcaaccaggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaacctgcagtggggcgatctgatcaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgcagcaccgctggcggtattatgccgattaccctgctggacggtcaaccggttaacggcggtcaggtaggcccgattaccaaaaagatttgggacggctactgggagatgcattacaatgccgcgtatagctttccggtcgattacggtagcggt

SEQ ID NO: 186 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGRNQEDLYNNNIYLLVLPYIWLMAPEDQLHGGEAIITRTVRRTPPGAFDPTIKNLQWGDLIKGMFEAMDRGATYPFLTDGDTHLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNAAYSFPVDYGSG

SEQ ID NO: 187 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccggcgttcgcggtcgccaagaggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaacctgcagtggggcgatctgatcaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgcagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 188 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKKILAEMVAKSGIRDAMVEVIVTRGLTGVRGRQEEDLYNNNIYLLVLPYIWLMAPEDQLHGGEAIITRTVRRTPPGAFDPTIKNLQWGDLIKGMFEAMDRGATYPFLTDGDTHLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNNAYSFPVDYGSG

SEQ ID NO: 189 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccggcgttcgcggtagccaagcggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaacctgcagtggggcgatctgatcaaaggcatgttcgaagcaatggatcgcggcgcaacctatccgtttctgaccgacggcgataccaacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 190 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKKILAEMVAKSGIRDAMVEVIVTRGLTGVRGSQAEDLYNNNIYLLVLPYIWLMAPEDQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMTSTAGGIMPITLLDGQPVNGGQVGPITKKIWDGYWEMHYNNAYSFPVDYGSG

SEQ ID NO: 191 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccggcgttcgcggtcgccaaccggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaacctgcagtggggcgatctgatcaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 192 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKKILAEMVAKSGIRDAMVEVIVTRGLTGVRGRQPEDLYNNNIYLLVLPYIWLMAPEDQLHGGEAIITRTVRRTPPGAFDPTIKNLQWGDLIKGMFEAMDRGATYPFLTDGDTHLTEGSGFNIVLVKNGIIYTPDRGVLEGITRKSVIDVARANSIDIRLEVVPVEQAYHSDEIFMTSTAGGIMPITLLDGQPVNGGQVGPITKKIWDGYWEMHYNNAYSFPVDYGSG

SEQ ID NO: 193 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaacctgcagtggggcgatctgatcaaaggcatgttcgaagcaatggatcgcggcgcaacctatccgtttctgaccgacggcgataccaacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 194 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKKILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMTSTAGGIMPITLLDGQPVNGGQVGPITKKIWDGYWEMHYNNAYSFPVDYGSG

SEQ ID NO: 195 - DNA, 969 bp, Artificial sequence
  Engineered sequence
atggcaagcatggataaagtcttcagcggctattacgcgcgtcaaaaactgctggagcgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgactggggtagtaaaccggaagacctgtacaacaacaacatctacctgctggttctgccgtatatctggctgatggcaccggaagatcaaatccacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttctgttgtagcaccgctggcggtattatgccgatcaccctgctggacggtcaaccggttaacggcggtcaggtaggcccgattaccaaaaagattatggacggctactgggagatgcattacaatccggcgtatagctttccggtcgattacggtagcggt

SEQ ID NO: 196 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGDWGSKPEDLYNNNIYLLVLPYIWLMAPEDQIHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFCCSTAGGIMPITLLDGQPVNGGQVGPITKKIMDGYWEMHYNPAYSFPVDYGSG

SEQ ID NO: 197 - DNA, 969 bp, Artificial sequence
  Engineered sequence
atggcaagcatggataaagtcttcagcggctattacgcgcgtcaaaaactgctgacgcgctctgataacccttttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccagcaacaggggtagtaaaccggaagacctgtacaacaacaacatctacctgctggttctgccgtatatctggctgatggcaccggaagatcaacgccacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttctgttgtagcaccgctggcggtattatgccggtcaccctgctggacggtcaaccggttaacggcggtcaggtaggcccgattaccaaaaagattatggacggctactgggagatgcattacaatccggcgtatagctttccggtcgattacggtagcggt

SEQ ID NO: 198 - protein, 323 aa, Artificial sequence
  Engineered sequence
MASMDKVFSGYYARQKLLTRSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTSNRGSKPEDLYNNNIYLLVLPYIWLMAPEDQRHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFCCSTAGGIMPVTLLDGQPVNGGQVGPITKKIMDGYWEMHYNPAYSFPVDYGSG

SEQ ID NO: 199 - DNA, 969 bp, Artificial sequence
  Engineered sequence
atggcaagcatggataaagtcttcagcggctattacgcgcgtcaaaaactgctggagcgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgtctggggtagtaaaccggaagacctgtacaacaacaacatctacctgctggttctgccgtatatctggctgatggcaccggaagatcaacgccacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgatcaccctgctggacggtcaaccggttaacggcggtcaggtaggcccgattaccaaaaagatttgggacggctactgggagatgcattacaatccggcgtatagctttccggtcgattacggtagcggt

SEQ ID NO: 200 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVWGSKPEDLYNNNIYLLVLPYIWLMAPEDQRHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 201 - DNA, 969 bp, Artificial sequence
  Engineered sequence
atggcaagcatggataaagtcttcagcggctattacgcgcgtcaaaaactgctggcgcgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccagcgtctggggtagtaaaccggaagacctgtacaacaacaacatctacctgctggttctgccgtatatctggctgatggcaccggaagatcaactccacggcggcgaagcaattattacccgtaccgttcgtcgtaccccgccgggcgcatttgatccgaccattaaaaacctgcagtggggcgatctgatcaaaggcatgttcgaagcaatggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgatcaccctgctggacggtcaaccggttaacggcggtcaggtaggcccgattaccaaaaagattatggacggctactgggagatgcattacaatccggcgtatagctttccggtcgattacggtagcggt

SEQ ID NO: 202 - protein, 323 aa, Artificial sequence
  Engineered sequence
MASMDKVFSGYYARQKLLARSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTSVWGSKPEDLYNNNIYLLVLPYIWLMAPEDQLHGGEAIITRTVRRTPPGAFDPTIKNLQWGDLIKGMFEAMDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIMDGYWEMHYNPAYSFPVDYGSG

SEQ ID NO: 203 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatggtggaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 204 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMVEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 205 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgatgtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 206 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLMWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 207 - DNA, 969 bp, Artificial sequence
  Engineered sequence
atggcaagcatggataaagtcttcagcggctattacgcgcgtcaaaaactgcatgaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 208 - protein, 323 aa, Artificial sequence
  Engineered sequence
MASMDKVFSGYYARQKLHERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 209 - DNA, 969 bp, Artificial sequence
  Engineered sequence
atggcaagcatggataaagtcttcagcggctattacgcgcgtcaaaaactgattgaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 210 - protein, 323 aa, Artificial sequence
  Engineered sequence
MASMDKVFSGYYARQKLIERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 211 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtgggttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 212 - protein, 323 aa, Artificial sequence
  Engineered sequence
MASMDKVFSGYYARQKLLERSDNPFSKGIAWVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 213 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtacgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 214 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGTTGVRGSKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 215 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaagtgattgttacccgcggtctgaccggcgttcgcggtagcaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaactttcagtggggcgatctgatcaaaggcatgttcgaagcagaggatcgcggcgcaacctatccgtttctgaccgacggcgataccaacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggaaatgcattacaatccggcgtatagctttccggtcgattacggtagcggt

SEQ ID NO: 216 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNFQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 217 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaaattattgttacccgcggtctgaccggcgttcgcggtagcaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaactttcagtggggcgatctgatcaaaggcatgttcgaagcagaggatcgcggcgcaacctatccgtttctgaccgacggcgataccaacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgtgtagcaccgctggcggtattatgccgattaccctgctggacggtcaaccggttaacggcggtcaggtaggcccgattaccaaaaagatttgggacggctactggaacatgcattacaatccggcgtatagctttccggtcgattacggtagcggt

SEQ ID NO: 218 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKNILAEMVAKSGIRDAMVEIIVTRGLTGVRGSKPEDLYNNNIYLLVLPYIWLMAPEDQLHGGEAIITRTVRRTPPGAFDPTIKNFQWGDLIKGMFEAEDRGATYPFLTDGDTNLTEGSGFNIVLVKNGIIYTPDRGVLEGITRKSVIDVARANSIDIRLEVVPVEAAYHSDEIFMCSTAGGIMPITLLDGQPVNGGQVGPITKKIWDGYWNMHYNPAYSFPVDYGSG

SEQ ID NO: 219 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaaattattgttacccgcggtctgaccggcgttcgcggtaacaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgatacccatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgtgtagcaccgctggcggtattatgccgattaccctgctggacggtcaaccggttaacggcggtcaggtaggcccgattaccaaaaagatttgggacggctactggaacatgcattacaatccggcgtatagctttccggtcgattacggtagcggt

SEQ ID NO: 220 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKNILAEMVAKSGIRDAMVEIIVTRGLTGVRGNKPEDLYNNNIYLLVLPYIWLMAPEDQLHGGEAIITRTVRRTPPGAFDPTIKNLQWGDLIKGMFEAEDRGATYPFLTDGDTHLTEGSGFNIVLVKNGIIYTPDRGVLEGITRKSVIDVARANSIDIRLEVVPVEAAYHSDEIFMCSTAGGIMPITLLDGQPVNGGQVGPITKKIWDGYWNMHYNPAYSFPVDYGSG

SEQ ID NO: 221 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaaattattgttacccgcggtctgaccggcgttcgcggtaacaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaactttcagtggggcgatctgatcaaaggcatgttcgaagcagaggatcgcggcgcaacctatccgtttctgaccgacggcgatacccatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactggaacatgcattacaatccggcgtatagctttccggtcgattacggtagcggt

SEQ ID NO: 222 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRILESCDKMRLKFPLALSSVKNILAEMVAKSGIRDAMVEIIVTRGLTGVRGNKPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWNMHYNPAYSFPVDYGSG

SEQ ID NO: 223 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaaattattgttacccgcggtctgaccggcgttcgcggtagcaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaactttcagtggggcgatctgatcaaaggcatgttcgaagcagaggatcgcggcgcaacctatccgtttctgaccgacggcgatacccatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggaaatgcattacaatccggcgtatagctttccggtcgattacggtagcggt

SEQ ID NO: 224 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRILESCDKMRLKFPLALSSVKNILAEMVAKSGIRDAMVEIIVTRGLTGVRGSKPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 225 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaaattattgttacccgcggtctgaccggcgttcgcggtagcaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaactttcagtggggcgatctgatcaaaggcatgttcgaagcagaggatcgcggcgcaacctatccgtttctgaccgacggcgatacccatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgtgtagcaccgctggcggtattatgccgattaccctgctggacggtcaaccggttaacggcggtcaggtaggcccgattaccaaaaagatttgggacggctactgggaaatgcattacaatccggcgtatagctttccggtcgattacggtagcggt

SEQ ID NO: 226 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEIIVTRGLTGVRGSKPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEAAYHSDEIFMCSTAGGIMPITLLDGQPVNGGQVGPITKKIWDGYWEMHYNPAYSFPVDYGSG

SEQ ID NO: 227 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaagtgattgttacccgcggtctgaccggcgttcgcggtagcaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaactttcagtggggcgatctgatcaaaggcatgttcgaagcagaggatcgcggcgcaacctatccgtttctgaccgacggcgatacccatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgtgtagcaccgctggcggtattatgccgattaccctgctggacggtcaaccggttaacggcggtcaggtaggcccgattaccaaaaagatttgggacggctactgggaaatgcattacaatccggcgtatagctttccggtcgattacggtagcggt

SEQ ID NO: 228 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEAAYHSDEIFMCSTAGGIMPITLLDGQPVNGGQVGPITKKIWDGYWEMHYNPAYSFPVDYGSG

SEQ ID NO: 229 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaaattattgttacccgcggtctgaccggcgttcgcggtaacaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaactttcagtggggcgatctgatcaaaggcatgttcgaagcagaggatcgcggcgcaacctatccgtttctgaccgacggcgatacccatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgtgtagcaccgctggcggtattatgccgattaccctgctggacggtcaaccggttaacggcggtcaggtaggcccgattaccaaaaagatttgggacggctactggaacatgcattacaatccggcgtatagctttccggtcgattacggtagcggt

SEQ ID NO: 230 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRILESCDKMRLKFPLALSSVKNILAEMVAKSGIRDAMVEIIVTRGLTGVRGNKPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEAAYHSDEIFMCSTAGGIMPITLLDGQPVNGGQVGPITKKIWDGYWNMHYNPAYSFPVDYGSG

SEQ ID NO: 231 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaaattattgttacccgcggtctgaccggcgttcgcggtaacaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaactttcagtggggcgatctgatcaaaggcatgttcgaagcagaggatcgcggcgcaacctatccgtttctgaccgacggcgataccaacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgtgtagcaccgctggcggtattatgccgattaccctgctggacggtcaaccggttaacggcggtcaggtaggcccgattaccaaaaagatttgggacggctactgggaaatgcattacaatccggcgtatagctttccggtcgattacggtagcggt

SEQ ID NO: 232 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRILESCDKMRLKFPLALSSVKNILAEMVAKSGIRDAMVEIIVTRGLTGVRGNKPEDLYNNNIYLLVLPYIWLMAPEDQLHGGEAIITRTVRRTPPGAFDPTIKNFQWGDLIKGMFEAEDRGATYPFLTDGDTNLTEGSGFNIVLVKNGIIYTPDRGVLEGITRKSVIDVARANSIDIRLEVVPVEAAYHSDEIFMCSTAGGIMPITLLDGQPVNGGQVGPITKKIWDGYWEMHYNPAYSFPVDYGSG

SEQ ID NO: 233 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaaattattgttacccgcggtctgaccggcgttcgcggtagcaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgatacccatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgtgtagcaccgctggcggtattatgccgattaccctgctggacggtcaaccggttaacggcggtcaggtaggcccgattaccaaaaagatttgggacggctactgggaaatgcattacaatccggcgtatagctttccggtcgattacggtagcggt

SEQ ID NO: 234 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKNILAEMVAKSGIRDAMVEIIVTRGLTGVRGSKPEDLYNNNIYLLVLPYIWLMAPEDQLHGGEAIITRTVRRTPPGAFDPTIKNLQWGDLIKGMFEAEDRGATYPFLTDGDTHLTEGSGFNIVLVKNGIIYTPDRGVLEGITRKSVIDVARANSIDIRLEVVPVEAAYHSDEIFMCSTAGGIMPITLLDGQPVNGGQVGPITKKIWDGYWEMHYNPAYSFPVDYGSG

SEQ ID NO: 235 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaagtgattgttacccgcggtctgaccggcgttcgcggtagcaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaactttcagtggggcgatctgatcaaaggcatgttcgaagcagaggatcgcggcgcaacctatccgtttctgaccgacggcgataccaacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgtgtagcaccgctggcggtattatgccgattaccctgctggacggtcaaccggttaacggcggtcaggtaggcccgattaccaaaaagatttgggacggctactgggaaatgcattacaatccggcgtatagctttccggtcgattacggtagcggt

SEQ ID NO: 236 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNFQWGDLIKGMFEAEDRGATYPFLTDGDTNLTEGSGFNIVLVKNGIIYTPDRGVLEGITRKSVIDVARANSIDIRLEVVPVEAAYHSDEIFMCSTAGGIMPITLLDGQPVNGGQVGPITKKIWDGYWEMHYNPAYSFPVDYGSG

SEQ ID NO: 237 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaagtgattgttacccgcggtctgaccggcgttcgcggtagcaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaactttcagtggggcgatctgatcaaaggcatgttcgaagcagaggatcgcggcgcaacctatccgtttctgaccgacggcgatacccatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgtgtagcaccgctggcggtattatgccgattaccctgctggacggtcaaccggttaacggcggtcaggtaggcccgattaccaaaaagatttgggacggctactgggaaatgcattacaatccggcgtatagctttccggtcgattacggtagcggt

SEQ ID NO: 238 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEAAYHSDEIFMCSTAGGIMPITLLDGQPVNGGQVGPITKKIWDGYWEMHYNPAYSFPVDYGSG

SEQ ID NO: 239 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaaattattgttacccgcggtctgaccggcgttcgcggtaacaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaactttcagtggggcgatctgatcaaaggcatgttcgaagcagaggatcgcggcgcaacctatccgtttctgaccgacggcgataccaacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggaaatgcattacaatccggcgtatagctttccggtcgattacggtagcggt

SEQ ID NO: 240 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKNILAEMVAKSGIRDAMVEIIVTRGLTGVRGNKPEDLYNNNIYLLVLPYIWLMAPEDQLHGGEAIITRTVRRTPPGAFDPTIKNFQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 241 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaaattattgttacccgcggtctgaccggcgttcgcggtagcaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaactttcagtggggcgatctgatcaaaggcatgttcgaagcagaggatcgcggcgcaacctatccgtttctgaccgacggcgatacccatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgtgtagcaccgctggcggtattatgccgattaccctgctggacggtcaaccggttaacggcggtcaggtaggcccgattaccaaaaagatttgggacggctactgggaaatgcattacaatccggcgtatagctttccggtcgattacggtagcggt

SEQ ID NO: 242 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKNILAEMVAKSGIRDAMVEIIVTRGLTGVRGSKPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEAAYHSDEIFMCSTAGGIMPITLLDGQPVNGGQVGPITKKIWDGYWEMHYNPAYSFPVDYGSG

SEQ ID NO: 243 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaagtgattgttacccgcggtctgaccggcgttcgcggtaacaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaactttcagtggggcgatctgatcaaaggcatgttcgaagcagaggatcgcggcgcaacctatccgtttctgaccgacggcgataccaacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgtgtagcaccgctggcggtattatgccgattaccctgctggacggtcaaccggttaacggcggtcaggtaggcccgattaccaaaaagatttgggacggctactgggaaatgcattacaatccggcgtatagctttccggtcgattacggtagcggt

SEQ ID NO: 244 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKNILAEMVAKSGIRDAMVEVIVTRGLTGVRGNKPEDLYNNNIYLLVLPYIWLMAPEDQLHGGEAIITRTVRRTPPGAFDPTIKNFQWGDLIKGMFEAEDRGATYPFLTDGDTNLTEGSGFNIVLVKNGIIYTPDRGVLEGITRKSVIDVARANSIDIRLEVVPVEAAYHSDEIFMCSTAGGIMPITLLDGQPVNGGQVGPITKKIWDGYWEMHYNPAYSFPVDYGSG

SEQ ID NO: 245 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaaattattgttacccgcggtctgaccggcgttcgcggtagcaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaactttcagtggggcgatctgatcaaaggcatgttcgaagcagaggatcgcggcgcaacctatccgtttctgaccgacggcgatacccatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggaaatgcattacaatccggcgtatagctttccggtcgattacggtagcggt

SEQ ID NO: 246 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKNILAEMVAKSGIRDAMVEIIVTRGLTGVRGSKPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 247 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaaattattgttacccgcggtctgaccggcgttcgcggtagcaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaactttcagtggggcgatctgatcaaaggcatgttcgaagcagaggatcgcggcgcaacctatccgtttctgaccgacggcgataccaacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgtgtagcaccgctggcggtattatgccgattaccctgctggacggtcaaccggttaacggcggtcaggtaggcccgattaccaaaaagatttgggacggctactggaacatgcattacaatccggcgtatagctttccggtcgattacggtagcggt

SEQ ID NO: 248 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKNILAEMVAKSGIRDAMVEIIVTRGLTGVRGSKPEDLYNNNIYLLVLPYIWLMAPEDQLHGGEAIITRTVRRTPPGAFDPTIKNFQWGDLIKGMFEAEDRGATYPFLTDGDTNLTEGSGFNIVLVKNGIIYTPDRGVLEGITRKSVIDVARANSIDIRLEVVPVEAAYHSDEIFMCSTAGGIMPITLLDGQPVNGGQVGPITKKIWDGYWNMHYNPAYSFPVDYGSG

SEQ ID NO: 249 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaaattattgttacccgcggtctgaccggcgttcgcggtaacaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgtgtagcaccgctggcggtattatgccgattaccctgctggacggtcaaccggttaacggcggtcaggtaggcccgattaccaaaaagatttgggacggctactgggaaatgcattacaatccggcgtatagctttccggtcgattacggtagcggt

SEQ ID NO: 250 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKNILAEMVAKSGIRDAMVEIIVTRGLTGVRGNKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEAAYHSDEIFMCSTAGGIMPITLLDGQPVNGGQVGPITKKIWDGYWEMHYNPAYSFPVDYGSG

SEQ ID NO: 251 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaaattattgttacccgcggtctgaccggcgttcgcggtaacaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaactttcagtggggcgatctgatcaaaggcatgttcgaagcagaggatcgcggcgcaacctatccgtttctgaccgacggcgataccaacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggaaatgcattacaatccggcgtatagctttccggtcgattacggtagcggt

SEQ ID NO: 252 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRILESCDKMRLKFPLALSSVKNILAEMVAKSGIRDAMVEIIVTRGLTGVRGNKPEDLYNNNIYLLVLPYIWLMAPEDQLHGGEAIITRTVRRTPPGAFDPTIKNFQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 253 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaagtgattgttacccgcggtctgaccggcgttcgcggtaacaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaactttcagtggggcgatctgatcaaaggcatgttcgaagcagaggatcgcggcgcaacctatccgtttctgaccgacggcgataccaacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggaaatgcattacaatccggcgtatagctttccggtcgattacggtagcggt

SEQ ID NO: 254 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKNILAEMVAKSGIRDAMVEVIVTRGLTGVRGNKPEDLYNNNIYLLVLPYIWLMAPEDQLHGGEAIITRTVRRTPPGAFDPTIKNFQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 255 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacgcggacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 256 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHADEIFMCSTAGGIMPITLLDGQPVNGGQVGPITKKIWDGYWEMHYNPAYSFPVDYGSG

SEQ ID NO: 257 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattgcggtttgggacggccgctttttccgtctggacgatcatctgcagcgtattctggaatcctgcgacaaaatgcgcctgaaatttccgctggcactgagcagcgttaaaaacatcctgcatgaaatggttgcgaaatctggtattcgcgatgcgatggtccatgttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacgcggacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 258 - protein, 323 aa, Artificial sequence
  Engineered sequence
MASMDKVFSGYYARQKLLERSDNPFSKGIAYVEGKLVLPSDARIPLLDEGFMHSDATYTTIAVWDGRFFRLDDHLQRILESCDKMRLKFPLALSSVKNILHEMVAKSGIRDAMVHVIVTRGLTGVRGSKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHADEIFMCSTAGGIMPITLLDGQPVNGGQVGPITKKIWDGYWEMHYNPAYSFPVDYGSG

SEQ ID NO: 259 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattgcggtttgggacggccgctttttccgtctggacgatcatctgcagcgtattctggaatcctgcgacaaaatgcgcctgaaatttccgctggcactgagcagcgttaaaaacatcctgcatgaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 260 - protein, 323 aa, Artificial sequence
  Engineered sequence
MASMDKVFSGYYARQKLLERSDNPFSKGIAYVEGKLVLPSDARIPLLDEGFMHSDATYTTIAVWDGRFFRLDDHLQRILESCDKMRLKFPLALSSVKNILHEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 261 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattgcggtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacgcggacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 262 - protein, 323 aa, Artificial sequence
  Engineered sequence
MASMDKVFSGYYARQKLLERSDNPFSKGIAYVEGKLVLPSDARIPLLDEGFMHSDATYTTIAVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHADEIFMCSTAGGIMPITLLDGQPVNGGQVGPITKKIWDGYWEMHYNPAYSFPVDYGSG

SEQ ID NO: 263 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgtcgggcgttggcggtagcaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 264 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKNILAEMVAKSGIRDAMVEVIVTRGLSGVGGSKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 265 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgtcgggcgttggcaagagcaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 266 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKNILAEMVAKSGIRDAMVEVIVTRGLSGVGKSKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 267 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgacgggcgttgacaagagcaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 268 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKNILAEMVAKSGIRDAMVEVIVTRGLTGVDKSKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 269 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgtcgggcgttggcaagaacaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 270 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKNILAEMVAKSGIRDAMVEVIVTRGLSGVGKNKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 271 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgtcgggcgttcacggtagcaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 272 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKNILAEMVAKSGIRDAMVEVIVTRGLSGVHGSKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 273 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaagaacttcatgtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 274 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNFMWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 275 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggcttatggcaccggaaaagcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 276 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEKQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 277 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcatactggtcaaaaacggcatcatctacaccccggatcgcggcgttctggaaggtatcactcgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 278 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAEDRGATYPFLTDGDTNLTEGSGFNIILVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 279 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcttactggtcaaaaacggcatcatctacaccccggatcgcggcgttctggaaggtatcactcgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 280 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAEDRGATYPFLTDGDTNLTEGSGFNILLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 281 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaaaatcaactgaggggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 282 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPENQLRGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 283 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgacggacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 284 - protein, 323 aa, Artificial sequence
  Engineered sequence
MASMDKVFSGYYARQKLLERSDNPFSKGIAYVEGKLVLPTDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 285 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgtttttgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 286 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVFDVARANSIDIRLEVVPVEQAYHSDEIFMCSTAGGIMPITLLDGQPVNGGQVGPITKKIWDGYWEMHYNPAYSFPVDYGSG

SEQ ID NO: 287 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtgtgatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 288 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGVMPITLLDGQPVNGGQVGPITKKIWDGYWEMHYNPAYSFPVDYGSG

SEQ ID NO: 289 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattgtgacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 290 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIVTRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 291 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcctgtacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 292 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGILYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 293 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccagcaatcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaacctgcagtggggcgatctgatcaaaggcatgttcgaagcagaagatcgcggcgcaacctatccgtttctgaccgacggcgatacccacctgactgaaggtccgggttttaacattgtcctggtcaaaaacggcatcctgtataccccggatcgtggcgttctggaaggtattacccgcaaaagcgttattgaagttgcgcgcgcaaattccattgatgtccgcctggaagttgttccggttgaaaccgcataccacgcggacgaaatcttcatgaccagcaccgctggcggtattatgccggtgaccctgctggacggtcaaccggttaacggcggtcaggtaggcccgattaccaaaaagatttgggacggctactgggagatgcattacaataacgcgtatagctttccggtcgattacggtagcggt

SEQ ID NO: 294 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKKILAEMVAKSGIRDAMVEVIVTRGLTSNRGRQPEDLYNNNIYLLVLPYIWLMAPEDQRHGGEAIITRTVRRTPPGAFDPTIKNLQWGDLIKGMFEAEDRGATYPFLTDGDTHLTEGPGFNIVLVKNGILYTPDRGVLEGITRKSVIEVARANSIDVRLEVVPVETAYHADEIFMTSTAGGIMPVTLLDGQPVNGGQVGPITKKIWDGYWEMHYNNAYSFPVDYGSG

SEQ ID NO: 295 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccagcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 296 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKKILAEMVAKSGIRDAMVEVIVTRGLTSVRGRQPEDLYNNNIYLLVLPYIWLMAPEDQRHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEQAYHSDEIFMTSTAGGIMPITLLDGQPVNGGQVGPITKKIWDGYWEMHYNNAYSFPVDYGSG

SEQ ID NO: 297 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccggcgttcgcggtcgccaaccggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaacctgcagtggggcgatctgatcaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagattatggacggctactgggagatgcattacaataacgcgtatagctttccggtcgattacggtagcggt

SEQ ID NO: 298 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKKILAEMVAKSGIRDAMVEVIVTRGLTGVRGRQPEDLYNNNIYLLVLPYIWLMAPEDQLHGGEAIITRTVRRTPPGAFDPTIKNLQWGDLIKGMFEAMDRGATYPFLTDGDTHLTEGSGFNIVLVKNGIIYTPDRGVLEGITRKSVIDVARANSIDIRLEVVPVEQAYHSDEIFMTSTAGGIMPITLLDGQPVNGGQVGPITKKIMDGYWEMHYNNAYSFPVDYGSG

SEQ ID NO: 299 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgatcagcaatcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtaaaccggttaacgacggtcaggtaggcccgattaccaaaaagatttgggacggctactgggagatgcattacaataacgcgtatagctttccggtcgattacggtagcggt

SEQ ID NO: 300 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKKILAEMVAKSGIRDAMVEVIVTRGLISNRGRQPEDLYNNNIYLLVLPYIWLMAPEDQRHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEQAYHSDEIFMTSTAGGIMPITLLDGKPVNDGQVGPITKKIWDGYWEMHYNNAYSFPVDYGSG

SEQ ID NO: 301 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccggcgttcgcggtcgccaaccggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccggtgaccctgctggacggtcaaccggttaacgacggtcaggtaggcccgattaccaaaaagattatggacggctactgggagatgcattacaataacgcgtatagctttccggtcgattacggtagcggt

SEQ ID NO: 302 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKKILAEMVAKSGIRDAMVEVIVTRGLTGVRGRQPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEQAYHSDEIFMTSTAGGIMPVTLLDGQPVNDGQVGPITKKIMDGYWEMHYNNAYSFPVDYGSG

SEQ ID NO: 303 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccagcgttcgcggtcgccaaccggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagattatggacggctactgggagatgcattacaataacgcgtatagctttccggtcgattacggtagcggt

SEQ ID NO: 304 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKKILAEMVAKSGIRDAMVEVIVTRGLTSVRGRQPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEQAYHSDEIFMTSTAGGIMPITLLDGQPVNGGQVGPITKKIMDGYWEMHYNNAYSFPVDYGSG

SEQ ID NO: 305 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccagcgttcgcggtcgccaaccggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattacaaaaaagatttgggacggctactgggagatgcattacaataacgcgtatagctttccggtagattatggtagcgat

SEQ ID NO: 306 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKKILAEMVAKSGIRDAMVEVIVTRGLTSVRGRQPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEQAYHSDEIFMTSTAGGIMPITLLDGQPVNGGQVGPITKKIWDGYWEMHYNNAYSFPVDYGSD

SEQ ID NO: 307 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 308 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKKILAEMVAKSGIRDAMVEVIVTRGLTGVRGRQPEDLYNNNIYLLVLPYIWLMAPEDQRHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEQAYHSDEIFMTSTAGGIMPITLLDGQPVNGGQVGPITKKIWDGYWEMHYNNAYSFPVDYGSG

SEQ ID NO: 309 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccggcaatcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattataacgcggcgtacagctttccggtagattatggtagcgat

SEQ ID NO: 310 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKKILAEMVAKSGIRDAMVEVIVTRGLTGNRGRQPEDLYNNNIYLLVLPYIWLMAPEDQRHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEQAYHSDEIFMTSTAGGIMPITLLDGQPVNGGQVGPITKKIWDGYWEMHYNAAYSFPVDYGSD

SEQ ID NO: 311 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgccggacgaagcctttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaacatcctggcggaaatggttgcgaaatctggtattcgcgatgcgatggtcgaagttattgttacccgcggtctgaccggcgttcgcggtagtaaaccggaagacctgtacaacaacaacatctacctgctggttctgccgtatatctggctgatggcaccggaagatcaactgcacggcggcgaagcaattattacccgtaccgttcgtcgtaccccgccgggcgcatttgatccgaccattaaaaacctgcagtggggcgatctgatcaaaggcatgttcgaagcagaggatcgcggcgcaacctatccgtttctgaccgacggcgataccaatctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgtgtagcaccgctggcggtattatgccgattaccctgctggacggtcaaccggttaacggcggtcaggtaggcccgattaccaaaaagatttgggacggctactgggagatgcattacaatccggcgtatagctttccggtcgattacggtagcggt

SEQ ID NO: 312 - protein, 323 aa, Artificial sequence
  Engineered sequence
MASMDKVFSGYYARQKLLERSDNPFSKGIAYVEGKLVLPSDARIPLPDEAFMHSDATYTTISVWDGRFFRLDDHLQRILESCDKMRLKFPLALSSVKNILAEMVAKSGIRDAMVEVIVTRGLTGVRGSKPEDLYNNNIYLLVLPYIWLMAPEDQLHGGEAIITRTVRRTPPGAFDPTIKNLQWGDLIKGMFEAEDRGATYPFLTDGDTNLTEGSGFNIVLVKNGIIYTPDRGVLEGITRKSVIDVARANSIDIRLEVVPVEQAYHSDEIFMCSTAGGIMPITLLDGQPVNGGQVGPITKKIWDGYWEMHYNPAYSFPVDYGSG

SEQ ID NO: 313 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccggcgttcgcggtcgccaaccggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagattatggacggctactgggagatgcattacaataacgcgtatagctttccggtcgattacggtagcggt

SEQ ID NO: 314 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKKILAEMVAKSGIRDAMVEVIVTRGLTGVRGRQPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEQAYHSDEIFMTSTAGGIMPITLLDGQPVNGGQVGPITKKIMDGYWEMHYNNAYSFPVDYGSG

SEQ ID NO: 315 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccagcaatcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagattatggacggctactgggagatgcattacaataacgcgtatagctttccggtcgattacggtagcggt

SEQ ID NO: 316 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKKILAEMVAKSGIRDAMVEVIVTRGLTSNRGRQPEDLYNNNIYLLVLPYIWLMAPEDQRHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEQAYHSDEIFMTSTAGGIMPITLLDGQPVNGGQVGPITKKIMDGYWEMHYNNAYSFPVDYGSG

SEQ ID NO: 317 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccagcaatcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 318 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKKILAEMVAKSGIRDAMVEVIVTRGLTSNRGRQPEDLYNNNIYLLVLPYIWLMAPEDQRHGGEAIITRTVRRTPPGAFDPTIKNFQWGDLIKGMFEAMDRGATYPFLTDGDTHLTEGSGFNIVLVKNGIIYTPDRGVLEGITRKSVIDVARANSIDIRLEVVPVEQAYHSDEIFMTSTAGGIMPITLLDGQPVNGGQVGPITKKIWDGYWEMHYNNAYSFPVDYGSG

SEQ ID NO: 319 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccagcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaacctgcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattataacgcggcgtacagctttccggtagattatggtagcgat

SEQ ID NO: 320 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKKILAEMVAKSGIRDAMVEVIVTRGLTSVRGRQPEDLYNNNIYLLVLPYIWLMAPEDQRHGGEAIITRTVRRTPPGAFDPTIKNLQWGDLIKGMFEAEDRGATYPFLTDGDTHLTEGSGFNIVLVKNGIIYTPDRGVLEGITRKSVIDVARANSIDIRLEVVPVEQAYHSDEIFMTSTAGGIMPITLLDGQPVNGGQVGPITKKIWDGYWEMHYNAAYSFPVDYGSD

SEQ ID NO: 321 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccggcaatcgcggtcgccaaccggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 322 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKKILAEMVAKSGIRDAMVEVIVTRGLTGNRGRQPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEQAYHSDEIFMTSTAGGIMPITLLDGQPVNGGQVGPITKKIWDGYWEMHYNNAYSFPVDYGSG

SEQ ID NO: 323 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaaaatcctggcggaaatggttgcgaaatctggtattcgcgatgcgatggtcgaagtgattgttacccgcggtctgacaagcgttcgcggtcgccaaccggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactggaatatgcattacaataacgcgtatagctttccggtcgattacggtagcggt

SEQ ID NO: 324 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRILESCDKMRLKFPLALSSVKKILAEMVAKSGIRDAMVEVIVTRGLTSVRGRQPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWNMHYNNAYSFPVDYGSG

SEQ ID NO: 325 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccagcgttcgcggtcgccaaccggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaacctgcagtggggcgatctgatcaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 326 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKKILAEMVAKSGIRDAMVEIIVTRGLTSVRGRQPEDLYNNNIYLLVLPYIWLMAPEDQLHGGEAIITRTVRRTPPGAFDPTIKNLQWGDLIKGMFEAMDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 327 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccagcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccggtgaccctgctggacggtcaaccggttaacggcggtcaggtaggcccgattaccaaaaagatttgggacggctactgggagatgcattacaataacgcgtatagctttccggtcgattacggtagcggt

SEQ ID NO: 328 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRILESCDKMRLKFPLALSSVKKILAEMVAKSGIRDAMVEIIVTRGLTSVRGRQPEDLYNNNIYLLVLPYIWLMAPEDQRHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEAAYHSDEIFMTSTAGGIMPVTLLDGQPVNGGQVGPITKKIWDGYWEMHYNNAYSFPVDYGSG

SEQ ID NO: 329 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcaatcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaacctgcagtggggcgatctgatcaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 330 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKKILAEMVAKSGIRDAMVEIIVTRGLTGNRGRQPEDLYNNNIYLLVLPYIWLMAPEDQRHGGEAIITRTVRRTPPGAFDPTIKNLQWGDLIKGMFEAMDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 331 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccggcgttcgcggtcgccaaccggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactggaatatgcattacaataacgcgtatagctttccggtcgattacggtagcggt

SEQ ID NO: 332 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEVIVTRGLTGVRGRQPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWNMHYNNAYSFPVDYGSG

SEQ ID NO: 333 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaaaatcctggcggaaatggttgcgaaatctggtattcgcgatgcgatggtcgaagtgattgttacccgcggtctgaccagcgttcgcggtcgccaaccggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 334 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRILESCDKMRLKFPLALSSVKKILAEMVAKSGIRDAMVEVIVTRGLTSVRGRQPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEQAYHSDEIFMTSTAGGIMPITLLDGQPVNGGQVGPITKKIWDGYWEMHYNNAYSFPVDYGSG

SEQ ID NO: 335 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccagcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactggaatatgcattacaataacgcgtatagctttccggtcgattacggtagcggt

SEQ ID NO: 336 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKKILAEMVAKSGIRDAMVEIIVTRGLTSVRGRQPEDLYNNNIYLLVLPYIWLMAPEDQRHGGEAIITRTVRRTPPGAFDPTIKNFQWGDLIKGMFEAMDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWNMHYNNAYSFPVDYGSG

SEQ ID NO: 337 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcaatcgcggtcgccaaccggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagattatggacggctactgggagatgcattacaataacgcgtatagctttccggtcgattacggtagcggt

SEQ ID NO: 338 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGNRGRQPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIMDGYWEMHYNNAYSFPVDYGSG

SEQ ID NO: 339 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcaatcgcggtcgccaaccggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 340 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKKILAEMVAKSGIRDAMVEIIVTRGLTGNRGRQPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 341 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccagcaatcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaacctgcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttctgcaccagcaccgctggcggtattatgccgattaccctgctggacggtaaaccggttaacgacggtcaggtaggcccgattaccaaaaagatttgggacggctactgggagatgcattacaataacgcgtatagctttccggtcgattacggtagcggt

SEQ ID NO: 342 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKKILAEMVAKSGIRDAMVEIIVTRGLTSNRGRQPEDLYNNNIYLLVLPYIWLMAPEDQRHGGEAIITRTVRRTPPGAFDPTIKNLQWGDLIKGMFEAEDRGATYPFLTDGDTHLTEGSGFNIVLVKNGIIYTPDRGVLEGITRKSVIDVARANSIDIRLEVVPVEAAYHSDEIFCTSTAGGIMPITLLDGKPVNDGQVGPITKKIWDGYWEMHYNNAYSFPVDYGSG

SEQ ID NO: 343 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtattctggaatcctgcgacaaaatgcgcctgaaatttccgctggcactgagcagcgttaaaaaaatcctggcggaaatggttgcgaaatctggtattcgcgatgcgatggtcgaagttattgttacccgcggtctgaccggcgttcgcggtcgccaaccggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 344 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRILESCDKMRLKFPLALSSVKKILAEMVAKSGIRDAMVEVIVTRGLTGVRGRQPEDLYNNNIYLLVLPYIWLMAPEDQLHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEQAYHSDEIFMTSTAGGIMPITLLDGQPVNGGQVGPITKKIWDGYWEMHYNNAYSFPVDYGSG

SEQ ID NO: 345 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaagtgattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagatttgggacggctactggaatatgcattacaataacgcgtatagctttccggtcgattacggtagcggt

SEQ ID NO: 346 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKKILAEMVAKSGIRDAMVEVIVTRGLTGVRGRQPEDLYNNNIYLLVLPYIWLMAPEDQRHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEQAYHSDEIFMTSTAGGIMPITLLDGQPVNGGQVGPITKKIWDGYWNMHYNNAYSFPVDYGSG

SEQ ID NO: 347 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcaatcgcggtcgccaaccggaagacctgtacaacaacaacatctacctgctggttctgccgtatatctggctgatggcaccggaagatcaactgcacggcggcgaagcaattattacccgtaccgttcgtcgtaccccgccgggcgcattcgatccgaccattaaaaacctgcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 348 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGNRGRQPEDLYNNNIYLLVLPYIWLMAPEDQLHGGEAIITRTVRRTPPGAFDPTIKNLQWGDLIKGMFEAEDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 349 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaagtgattgttacccgcggtctgaccagcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaacaggcgtatcacagcgacgaaatcttcatgaccagcaccgctggcggtattatgccgattaccctgctggacggtcaaccggttaacggcggtcaggtaggcccgattaccaaaaagatttgggacggctactggaatatgcattacaataacgcgtatagctttccggtcgattacggtagcggt

SEQ ID NO: 350 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEVIVTRGLTSVRGRQPEDLYNNNIYLLVLPYIWLMAPEDQRHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEQAYHSDEIFMTSTAGGIMPITLLDGQPVNGGQVGPITKKIWDGYWNMHYNNAYSFPVDYGSG

SEQ ID NO: 351 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 352 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLIKGMFEAMDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 353 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaactggttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccagcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcagaagatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactggaatatgcattacaataacgcgtatagctttccggtcgattacggtagcggt

SEQ ID NO: 354 - protein, 323 aa, Artificial sequence
  Engineered sequence
MASMDKVFSGYYARQKLLERSDNPFSKGIAYVEGKLVLPSDARIPLLDEGFMHSDATYTTISVWDGRFFRLDDHLQRLLESCDKMRLKFPLALSSVKKILAEMVAKSGIRDAMVEIIVTRGLTSVRGRQPEDLYNNNIYLLVLPYIWLMAPEDQRHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWNMHYNNAYSFPVDYGSG

SEQ ID NO: 355 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcctgttcgaagcagaggatcgcggcgcaaagtatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 356 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLIKGLFEAEDRGAKYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 357 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcagaggatcgcggcgcacagtatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 358 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLIKGMFEAEDRGAQYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 359 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcaaaggatcgcggcgcagagtatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 360 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLIKGMFEAKDRGAEYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 361 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcctgttcgaagcaaaggatcgcggcgcagagtatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 362 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLIKGLFEAKDRGAEYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 363 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcaaacgatcgcggcgcagagtatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 364 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLIKGMFEANDRGAEYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 365 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcaaaggatcgcggcgcaaagtatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 366 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLIKGMFEAKDRGAKYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 367 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcagtggatcgcggcgcacagtatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 368 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLIKGMFEAVDRGAQYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 369 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcagaggatcgcggcgcaacgtatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 370 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLIKGMFEAEDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 371 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcagtggatcgcggcgcagagtatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 372 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLIKGMFEAVDRGAEYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 373 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcagacgatcgcggcgcacagtatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 374 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLIKGMFEADDRGAQYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 375 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcagtggatcgcggcgcaaagtatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 376 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLIKGMFEAVDRGAKYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 377 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcaaaggatcgcggcgcaacgtatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 378 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLIKGMFEAKDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 379 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcaatcgatcgcggcgcaaagtatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 380 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLIKGMFEAIDRGAKYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 381 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcctgttcgaagcagacgatcgcggcgcacagtatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 382 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLIKGLFEADDRGAQYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 383 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcgcagcgacgtgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgattttaccaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 384 - protein, 323 aa, Artificial sequence
  Engineered sequence
MASMDKVFSGYYARQKLLERSDNPFSKGIAYVEGKFVLPSDARIPLLDEGFMRSDVTYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDFTKGMFEAMDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 385 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcgcagcgactcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatttgaccaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 386 - protein, 323 aa, Artificial sequence
  Engineered sequence
MASMDKVFSGYYARQKLLERSDNPFSKGIAYVEGKFVLPSDARIPLLDEGFMRSDSTYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLTKGMFEAMDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 387 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcgcagcgacgtgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatttgaccaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 388 - protein, 323 aa, Artificial sequence
  Engineered sequence
MASMDKVFSGYYARQKLLERSDNPFSKGIAYVEGKFVLPSDARIPLLDEGFMRSDVTYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLTKGMFEAMDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 389 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacgcggacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 390 - protein, 323 aa, Artificial sequence
  Engineered sequence
MASMDKVFSGYYARQKLLERSDNPFSKGIAYVEGKFVLPSDARIPLLDEGFMHADATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLIKGMFEAMDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 391 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcaggtgatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 392 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFDPTIKNFQWGDLIKGMFEAGDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 393 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgcattcggtccgaccattaaaaactttcagtggggcgatctgatcaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 394 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGAFGPTIKNFQWGDLIKGMFEAMDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 395 - DNA, 969 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttcgcggtcgccaaccggaagacctgtacaacaacaacatctacctgctggttctgccgtatatctggctgatggcaccggaagatcaacgtcacggcggcgaagcaattattacccgtaccgttcgtcgtaccccgccgggcgatttcgatccgaccattaaaaactttcagtggggcgatctgatcaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 396 - protein, 323 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVRGRQPEDLYNNNIYLLVLPYIWLMAPEDQRHGGEAIITRTVRRTPPGDFDPTIKNFQWGDLIKGMFEAMDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 397 - DNA, 954 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtctgaccggcgttagcggctcttacaacaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 398 - protein, 318 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGLTGVSGSYNNNIYLLVLPYIWLMAPEDQRHGGEAIITRTVRRTPPGAFDPTIKNFQWGDLIKGMFEAMDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

SEQ ID NO: 399 - DNA, 936 bp, Artificial sequence
  Engineered sequence
atggcaagcatggataaagtcttcagcggctattacgcgcgtcaaaaactgctggaacgctctgataacccgtttagcaaaggcatcgcgtacgttgaaggtaaatttgttctgccgagcgacgcacgtattccgctgctggacgaaggttttatgcacagcgacgcgacctacactaccattagcgtttgggacggccgctttttccgtctggacgatcatctgcagcgtctgctggaatcctgcgacaaaatgcgcctgaaatttccgctggcactgagcagcgttaaaaaaatcctggcggaaatggttgcgaaatctggtattcgcgatgcgatggtcgaaattattgttacccgcggtagcggctctaacaacatctacctgctggttctgccgtatatctggctgatggcaccggaagatcaacgtcacggcggcgaagcaattattacccgtaccgttcgtcgtaccccgccgggcgcattcgatccgaccattaaaaactttcagtggggcgatctgatcaaaggcatgttcgaagcaatggatcgcggcgcaacctatccgtttctgaccgacggcgatacccacctgaccgaaggtagcggttttaacatcgtcctggtcaaaaacggcatcatctacaccccggatcgcggcgttctggaaggtattacccgtaaaagcgttattgacgttgcacgcgcaaacagtattgatattcgcctggaagtcgtcccggttgaagcggcgtatcacagcgacgaaatcttcatgaccagcaccgctggcggtattatgccgattaccctgctggacggtcaaccggttaacggcggtcaggtaggcccgattaccaaaaagatttgggacggctactgggagatgcattacaataacgcgtatagctttccggtcgattacggtagcggt

SEQ ID NO: 400 - protein, 312 aa, Artificial sequence
  Engineered sequence
MASMDKVFSGYYARQKLLERSDNPFSKGIAYVEGKFVLPSDARIPLLDEGFMHSDATYTTISVWDGRFFRLDDHLQRLLESCDKMRLKFPLALSSVKKILAEMVAKSGIRDAMVEIIVTRGSGSNNIYLLVLPYIWLMAPEDQRHGGEAIITRTVRRTPPGAFDPTIKNFQWGDLIKGMFEAMDRGATYPFLTDGDTHLTEGSGFNIVLVKNGIIYTPDRGVLEGITRKSVIDVARANSIDIRLEVVPVEAAYHSDEIFMTSTAGGIMPITLLDGQPVNGGQVGPITKKIWDGYWEMHYNNAYSFPVDYGSG

The invention claimed is:

1. An engineered transaminase polypeptide capable of converting acetophenone to R-(+)-α-phenylethylamine, wherein the amino acid sequence of said transaminase polypeptide includes a V60T substitution relative to SEQ ID NO: 2, further wherein said amino acid sequence is selected from the group consisting of SEQ ID NOs: 16, 18, 20, 22, 24, 26, 28, 30, 32, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, and 400.

2. The transaminase polypeptide of claim 1, wherein said engineered transaminase polypeptide is capable of converting acetophenone to R-(+)-α-phenylethylamine with a higher catalytic activity or stability than SEQ ID NO: 2 under reaction conditions defined as including 1 g/L to 200 g/L acetophenone, 0.5 M to 2.0 M isopropylamine, 50 μM to 5 mM pyridoxal 5'-phosphate (PLP), pH of 7.0-11.0, and a temperature of 10-60° C.

3. An engineered polypeptide, which is a polypeptide comprising an amino acid sequence selected from the group consisting of SEQ ID NOs: 16, 18, 20, 22, 24, 26, 28, 30, 32, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, and 400.

4. A polypeptide immobilized on a solid material by chemical bond or a physical adsorption method, wherein the polypeptide is selected from the transaminase polypeptides according to claim 1.

5. A process of preparing a chiral amine product of formula (I):

wherein the amine products of formula (I) have the indicated stereochemical configuration shown at the chiral center marked with an* and the amine products of formula (I) are in an enantiomeric excess over the other isomer, further wherein $R^1$ is an optionally substituted or unsubstituted aryl or heteroaryl, or optionally substituted or unsubstituted $C_1$-$C_8$ hydrocarbyl;

$R^2$ is an optionally substituted or unsubstituted $C_1$-$C_6$ hydrocarbyl, a halogen selected from among —F, —Cl, —Br, and —I, an —$NO_2$, —NO, —$SO_2R'$ or —SOR', —SR', —NR'R', —OR', —$CO_2R'$ or —COR', —C(O)NR', —$SO_2NH_2$ or —$SONH_2$, —CN, $CF_3$; wherein each R' is independently selected from —H or ($C_1$-$C_4$) hydrocarbyl, said the process comprising the steps of contacting, under suitable reaction conditions comprising a reaction solvent, an amine donor and the ketone substrate of formula (II)

with the transaminase polypeptide of claim 1 and converting the ketone substrate to the chiral amine product.

6. The process of claim 5, wherein the chiral amine product of formula (I) is:

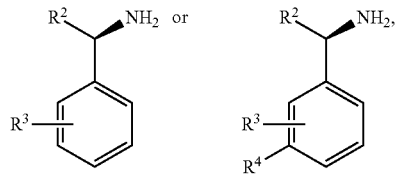

further wherein $R^2$ is an optionally substituted or unsubstituted $C_1$-$C_6$ hydrocarbyl, a halogen selected from among —F, —Cl, —Br, and —I), an —$NO_2$, —NO, —$SO_2R'$ or —SOR', —SR', —NR'R', —OR', —$CO_2R'$ or —COR', —C(O)NR', —$SO_2NH_2$ or —$SONH_2$, —CN, $CF_3$, wherein each R' is independently selected from —H or ($C_1$-$C_4$) hydrocarbyl;

$R^3$ and $R^4$ are each independently selected from among $C_1$-$C_4$ hydrocarbyl, —H, halogen selected from among —F, —Cl, —Br, and —I, an —$NO_2$, —NO, —$SO_2R'$ or —SOR', —SR', —NR'R', —OR', —$CO_2R'$ or —COR', —C(O)NR', —$SO_2NH_2$ or —$SONH_2$, —CN, $CF_3$, wherein each R' is independently selected from —H or ($C_1$-$C_4$) hydrocarbyl;

further wherein $R^3$ and $R^4$ may optionally together form

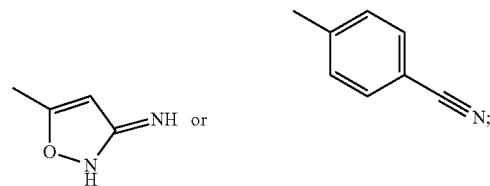

and the ketone substrate of structural formula (II) is:

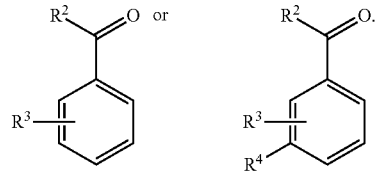

7. The process of claim 5, wherein the chiral amine product of formula (I) is selected from among:

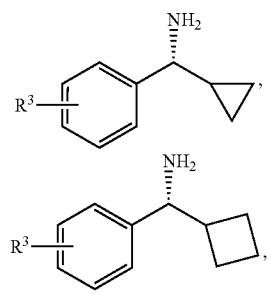

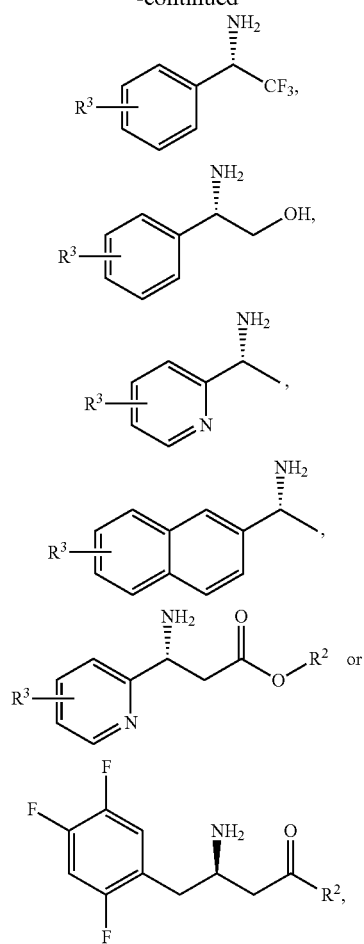
wherein R² and R³ are as defined in claim 6.
8. The process of claim 5, wherein the chiral amine product of formula (I) is selected from among.
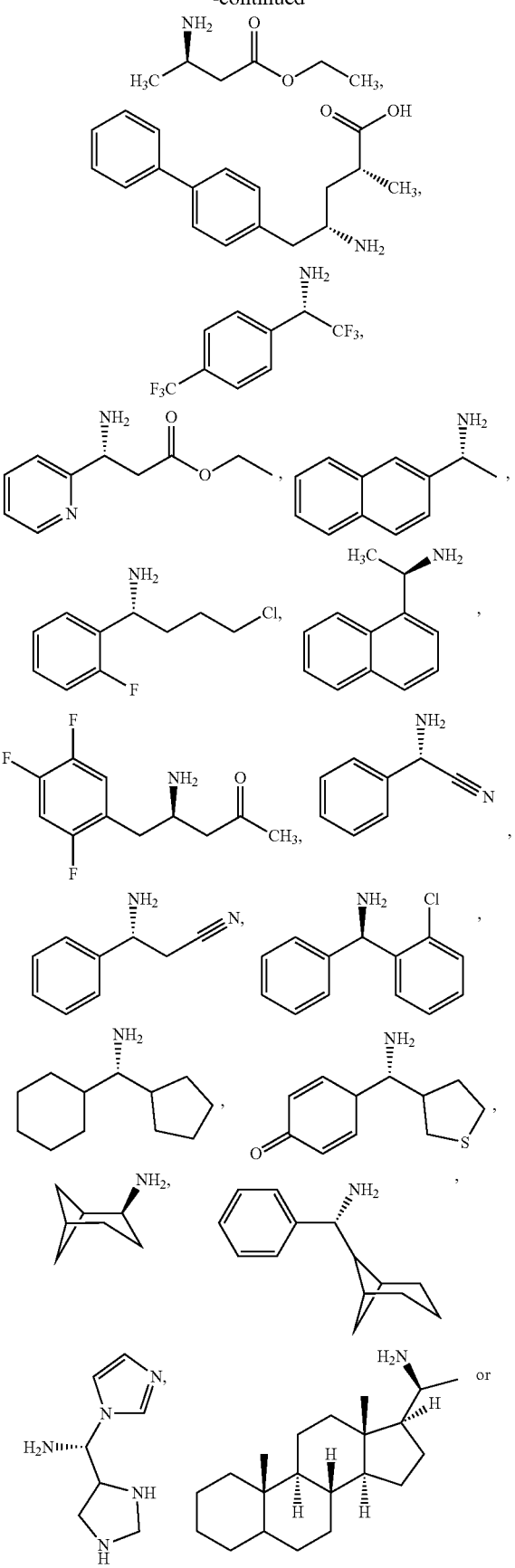

-continued

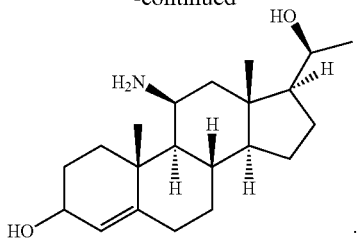

9. A process of preparing the compound of formula A2 R-(+)-α-phenylethylamine:

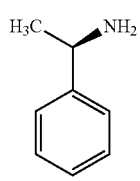 A2 wherein the process comprises the steps of: (i) contacting, under suitable reaction conditions, in a suitable organic solvent, in the presence of an amine donor, the compound of formula A1 acetophenone

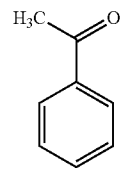 A1 with the transaminase polypeptide of claim 1 and (ii) converting said compound of formula A1 to a compound of formula A2.

10. The process of claim 5, wherein the chiral amine product is present in an enantiomeric excess of at least 70%, 80%, 85%, 90%, 91%, 92%, 93%, 94%, 95 of %, 96%, 97%, 98%, 99% or more.

11. The process of claim 5, wherein the reaction solvent is selected from among water, methanol, ethanol, propanol, isopropanol, isopropyl acetate, dimethyl sulfoxide (DMSO) and dimethylformamide (DMF).

12. The process of claim 5, wherein the reaction conditions include a temperature of 10° C. to 60° C.

13. The process of claim 5, wherein the reaction conditions include pH 7.0 to pH 11.0.

14. The process of claim 5, wherein the ketone substrate is present at a loading of 1 g/L to 200 g/L.

* * * * *